United States Patent 11,220,694 (RICE CELLS AND RICE PLANTS) - sequence listing, part 2

SEQ ID NO: 726 - DNA, 6279 bp, Oryza sativa
cgccgatgttggagaaaacggctctagcgacgattggatctcgacgagggatggaatagggtcattggactttggggagcctattggcgacagaggctggatcgattgggaacaaggacggtggaattgtgatgttccaagagggtaaggtgacgaaacaaggagatgatcggtgcgcatgtcgcacggggcagtgtcggtgatcgggcgctggagggagatggaggacaggtgaggggagcgacgaggggttctttgcggcatacgacgggaatgttgggtcccacgtgacggaggcgtatcgggagtatatgaacatggtattcgctgaggaggtgcggtttcgaaggctgctgtatggtgacgacagcatgaacatcgaggatgaagaccacgcccaatgaaaagagactgtggcggcctgctttgcctgtgtggacaacgaagtctgcgacgccaaggaagccgacacaagtaccatgtacgaatccacatatattttatatttagttctaaattattggagcggagggagaatgttatttaacaatgtataatcatgtctgcggataattgtagccaactcgtaaacaatggagctaatacgttaacatacggtccgacgcgtgtattgccctgcatccggttccataatccgccagtctgctgcgttcaccagtcaccaccatccgctacagagagacattaccgacttggttcggctcacttcacttgcatgttatttaacaatgtataatcatgtatgtggataattgtagccaactcgtaaacaatggagctgctacgttaacagacggtccgacgcgtgtattattgttctgtatccggttccacgatccgccaatccgctgcattcacccgtcaccaccacccgccacggagagacagtcccggctcggttcggctcacttcacttgcgtccccgtgggcgctcacatgctgcccatcctcccgcctccatcccccagcccagaccccagatccccccaccccaccacctcataaagaccaaaccaaacccaaaagcaaccaacgccatcccagcgcagcgcaggcacgcacggcaccggcggcggaggacgcggcaggagcagcagccgcctcctccaatccccgagccgaacactcgctggcgggcgcgcgcgcgcgcagccggggaaccgggggggagacagggtggtggtggtgaggcgggggcgagcgcaatgcaggagccaaagcacaccgatccggcggccatgcgcggggcgcaccaccgccgggccagatctgaggtcgccttccgcctgcccgacgacctcgacctcggcggcggcggcgcgggggcgttcgacgagatcggctccgaggacgacctcttctccaccttcatggacatcgagaagatctcctccggccccgccgccgcggggggctccgaccgggaccgcgccgcggagacgtcctcgccgccgcgccccaagcaccgccacagcagctccgtcgacggctccgggttcttcgccgccgcgcggaaggacgccgccgcatcgctggcggaggtcatggaggctaagaaggccatgacccccgagcagctctccgagctcgccgccatcgaccccaagcgcgccaaaaggtgcaaagcctccccgatctcccgctctccatccatccgcttgctctcgcgaatccgacgttgtcgttgatgcttagattagaaaggtgcccgtcacacgccatagattaacagattacctgtttcgtttctccaaggtagcagggaatcataccagacgaggtacctaggacaattatgcatgcatgcatctttctgaaaaatgcctggaggttagagaaaaagatgtgcatttgcgtcttgtttgtttctttgcgtactgtgtggattattggatagatggcgcttggtggttggttggcagatcaggagttaaggttataagtgctagttatcgagcactcggttggtgggattgttatggataagtgtttgctgctgtgaggtggcggcttggcgcatgcttttgttggcttttttttgctgggattgtgaaagggggtgggtcaatagagtaggtgtaatcgttagttactttttagttgtgcatatgcgctggttttaattcgatattagttactgtctaagatgctagatactgtttggatgtctgattagattgttttttgtttctctttgcttagctctggtacctaagaaatgtgatgaacaaatgttgcatctctagttaaactatgaaaatgtagcacaatgatatgcgattagtgacatgttattaaaccggattgtctggattgattgtgaaaggcagtgggactgtgggagcaacaaccaaaggatagacatccaatcgaataagagaaagcaacagtctcagttttggaattattctttgaggtcgtgtgtaggcgtgtagccaatcaaattagagaaaataccatcaccttctggagtagctatttaggggctgcaaatacttaatagtcaaaattttctatatcttaaagcaatcaaccaatataaaactgtgagggcagtacttcatttcttcaacacattgaagatgtgcattgatgccttctgcaatgtaggtctgtcaacttagatgttctaattatcagcatggttgtgatctcaccagtactaaaccatggtatactttccacctcaataaactattgctattcagtttaaccagatagtatatctaaacttatttttttacagttaacgtctgatgcgttaaaattgcattgcctccctttgttttctccctaattgtatgcagtaaacagtttgtgtgaaacatcaaccaaaaaagatcgctttacacatgccagttggttgacttgtctgtaattctgcacatgcttccgattttgttttgttttctaaacaatatacaaatgcttccccagttcatctttaatttaataaggttatccgggcaatgaatatttcttcttttctgttctgatatatacaaaaatactgaacataccattatttaacaaaatttgactacacttgtgtttgatgttgataaataacactcctatttctttcttgaaatctatggtgggatttatccctaattcatgatttcttttaaatttgtaaatattgtttgtaatgtggaaagtggattgaagatgaacaccctcaatcgctggcaaattatcattatgttcctgaaatatttttaaaccaggcaatttgtaatattttgttaacctcttgagtttgttctcttacagaattctggcgaacagacaatctgcagctcggtcaaaagagagaaaagctcgttacataacagaacttgagcggaaggttcaaactcttcagactgaagccactactctctcagcacaactcacactatttcaggtgcctttccatctatcttttgcctcatggtttaaatcatgagtttctggaaacagtaatcctgtactagtgaaacactgtttttccttggcaatcttagtaaacaaactggctgtcggctgttcctccatccccaatagttaccacttaccacacagcaaacaaactgtagcttctttgctagatgcaagaatcccatacaagacgagaaccaagttgcggcttccttgtggattgcatctagcttgatagtttttcatgtaccattggacaacttgtatgttgtatgcatgacttctgcacatgctatgatcattataaatatccattggattattttatatggctatgtgaacaccttgaagagctgaatgctgatggagtgcatgtgagaataaagaataaatctattcgttgacttttgactatcttgttataggttatgctattttgttgtgctgttgacttctgaaagagcataaaacctttcaatttatggctgtgctaaactactggctcttaaaacatttcttttactttcagagagacacaactgggctttctgcagaaaatgcagagctcaagatacggttgcaggccatggaacaacaggctcaactgcgagatggtgagcattttccttaactggataactatagttacttaacatttgttgtttttcatcaacaataactagtggtaaaagtataaaactgatcattatattggaaatgatagcatcaaagttcatttatcctttcctgatagacacacccttttcattttacaattcagtctagagctatcctagctatatacgttctatttgtgacatcttaaattttgtgccaaaagctagaatgatttttaatacggagacccgtgtaattatattggatatgtagaagtgatagctggagtatgaattgcaactgtgagcgtacctttctggttctaacaaaaagtgtgatataatttttcagctctgaatgatgcactaaagcaggaactggagaggcttaagctcgctactggtgagatgacaaattccaatgagacatatagcatgggactgcaacatgtcccatacaacacccctttcttccctctcgcccagcataatgcagcccgccagaacggtggaacccagttgccaccacaattccaaccaccccgtcctaatgtgcccaatcacatgctatcccatccaaacggtttgcaagatatcatgcagcaagaccctcttggccggcttcagggtttggacatcagcaaagggcctctagttgtgaaatcagagagcagctcgatctctgcaagtgaaagcagcagcaccttctaaccaggcctacccaccgagcccacagttccattagattcgtttgttcatagcctgacatcctcgcgctgctccctgttctgtaagcttattatttattcaattcgttcgatttagttgaaattgttcgtaattgcagtggctgatctattcccttctgtggacatgattcctgtacccctcacatccatttgttttgggttcatctcctgtgtgctgtgtttgggattatcagggcaccaggactggctttctccgagaatactgtgttctttgtggtcgtgtggacttgttcaccatggattcaattcaaccttttgaaaagatgcatgtattctctgatttttttttctcagtcatgtacatgtcactgttatgctagtttgattgatgtgtactgtggaatttgtggataacaaaaggagttaagattgggattgctgtggaaccatctgtatcgtatattcgtatgtgactaatgttgggaaattgttctattcttgttcaccatatgcatgtggggtaacttttccacttttcatagtctcttactattgtggaatatggatttgtatgcgtgttatgtactccgagcatttgtgcctgctaacaatgacttgacaaatactactattagaggccaaaagcttcgatccagtatttttgacaatgcacgcgtttacttcttgaggtttcaacaagacgaatcaaaattcaaatgatgcatgtgtgctgatcattttgcactctaaacctgctactgtttcgacctagagtgctgttgcaatacccttatgatcatccacgttaaagaccatatcgaattacaactctgacctgtatagttttcttaaatcttaaaaggggactggttcaccaattggcatatatacggctgatggcagcgaatccttaaaaaggaactggttcaccaatacggcaatacactaacgaacgtgacggaagcaaacgttaaaatcgtcaatccagtgggactacaattttcactggcgacagcttcatctatgtcctttcccctttttttttttatttttctgatgtcattttaaacaaatttgtcttctactcctcctccacctctcccgtgtcgatcaataaattgtttctttaaggaaatatcagtagtgaggtcggtttagggcaggtttgttttgttgtcactttccaccttaaaaaagtattatcaaagtttgatagggtaataaactaaacataattttaacattgctaccttattaaagattggcaattccaaaagttctctctcacaaaaactcaactaaaataagtaaggcttcaaaccaaacgtaaacaactctatcaaaattcagtaacatcaaaacgtgctaaaatttggcataactaaaattggtaagatttgttttggcaacaaagtaaacaaacccttaaatcctgacaactacgaatattatgaatatgtagctgaactttcacttgggcttcagtgttataaaaccagcccgaaatc

SEQ ID NO: 727 - DNA, 13947 bp, Oryza sativa
cgtcctcccaagccgtacccaatcatacccgtccatttccgatccatcgcgcgaaacccccacctcccacggatcgctccattttcacctccgcgcccaaacgcctcctcccaccgctataaataccccgcccatctcctccgcatctcacaagcaaaatccccaaatcctccagatcgtcttcgtcttccacctcgagctcttacgcatcgtcagccatgtcgggccgcggcaagggaggcaagggtcttggcaagggcggcgcgaagcggcacaggaaggtgctgcgcgacaacatccagggcatcaccaagccggcgatccggcggctggcgaggaggggcggcgtgaagcgcatctccgggctgatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggctgagttcccggccccctgtgctcgatccagatctgatgccgttagcgttgcttagggtttcgttgcggaaattgtactacttcgttgtttctgcttgtgcaaagtgaatggatggttggattaaatgaatcattttctctcttgattagtacatccgacttgctgtcttccaaaaaatgatccattggtcgctttgaaatgttgtatgcgctgatccatttttgaatttgagaggcggctatcttgaaaatttcgttgcaaactgcgcaatttcgcgctccatgtgaatgctcgtaatttgaacgatgtatcagctgagtggtctattggctttcaaaattcgagattcgaactggcggttttcctccaaaaaaagttcaacgggtgggtgggaaaaatccaaattgggctcttcgggactcgttggtatctgggccgaaagcccaactgggagtccaagcccacagcctcgttgccgaattttgccacctccccgtcgcggcggcgacagaggcagcgatcacccccaccggcgaccaccgccggctgcgccgccgccgctccggtgttccacccccattctctcccctcgtttgcccatctccaagggacccgccgcacaggcagagactgcgccttgacgccgcgaaacggaaccctcgctgcaagggcacgtggcctcctgctgctcggcgctctcgcgccgccgggcgattgtgggtggcgccggatttctcttcgcctcctcgtatgccggcgcgactgtgttcgggctggctcagcgtggccgctcgtctccctcccctttgcatccccactcctctccggcctccattgccactcccaggaggatagtagatcggtcgctttggcttccgagtctcatctcgggccagccgcgctggtctcctcagcgagtgaactcccctcatgcctcgcggccccaatccgaatgctctcgctgttaccggaggtggggtgcaggaggcatattgtgccgccgatcgaacaacaatgacggttgcgtactggaacaggtatgctgctacacccatcacctctttctttctttaatttggggctgtcaatgcagcttgcaggtatttgattctcagttgggcacgaaattagctctgaaatatgaagtactgtatgggttatttggcatgaggttgtggcactttagcatctccgacattgttgcatatgggcgaaatgagaaaatgggatgtcggatagtatttcaagaaaacaactgcccattgcctttttgatttggttatgcagagacgttctctgaattaagtgtgtgttgcactgatgcttgatgtcgattcaaattaactgtaacttgttgtaagtgacctattcaatctttagctgcaaaatttagggaccatttgcattgtctttacgaagaatgtggatttcaagccatgtctataatattaaggatttgtagttgtacttgtctatttagaaggttaactaaaaaaggtaaccttatttaactcttgctcacagctgtgctttgccacatatcaccattttgataactgtcctgaaccaaatttatccatatctggatgtctgattcagcatgaagtatgtaatgcgaatatgtgatacattatacttgtaaggtatcacaaacagaaggaaggcgcactgataacataccgcgcacttctatcttttgcagaatatctcacagctttccactggttggtgggtcggcatgactggtgagtggtggctgctgtgacagtttttgaacacgtccgctttccaatttttccttctgctaaatccatgataatttccagtttgtacaattggtttgtgcgagctaacatatgccaatcaaatatggggaccaagtttttctggtgcatctgcttactttgatggcatataacttgttttagatgtgtactgttatctcactgcatggttgaagccagttgaaaattgctgtgcacctcatatacatgaacgagagctgccattgttatcaattacaatttagttccatgtctgtatagccacagtttttcgtgtagtgtttagtcagcgtcaggcctcactgtaatgtatcaacataataaagaagtaccaatcagtgcgctaagagttgtgggtggtccttgcataagataaattctcctggctatggaaatttccatgaaagtgacttatctttgagagagagaaaaaatgtgtgtacataagctaactatgatcattttagacagtttaaatgtttaattgttattttgatgcataaacttgtacttgcacaactggatcttaaagggggagacttgtattgccatgcaagggtatgataggaaaatatcagttgtttaatctattatagtttgaatgtatgttagcagtcatgagaaagctatgaagtatccataatgtaggatataaacatcattacacatcacatataattttaaccgagaacatgactggtatatggaaaaacaaaagaacattgtggactggttcataatctagccttttaaactttataactctacatataacttgaggcgaagtcactctttatgtttgaaagcgtaaatataatattcagaaaacctgggtttataacgtaagttgcatgcattttgaagaaatctgcttgttcacagggtagttacggacttgcggagttatattgcagacttagctgcaggctgccagcctaccacaattgtttcatcgttcttgtgttaagttgaactttttttcttatgttagtctggaaagaaaaccggaagtgctaagggtaatgtgggcaaatataagccctcttaacttatgtgtttggataatagcagagattgaacattaccataataagcatgcaagtaggagttgtttatagtaatcgcttggggctgtatatcttcttatataaggttttagtagaatcttctgagtacatctaaaatcaatgtgtttgttgattaagttcaatttgtgcttctaggatcacgaaatcatggccaaaacacatgtgaaagccctgctgatggcttctcatacagaaattctaaattctagtacttgaacataagtattgtttaaaattcaattcagtggattgtagttttttttttaaaaaaaattaatgaattctgagtttctgacagttattaaacacaagaaaattctgaaattagaaatgtaacagactatcagtgtaaactttttgaactgttcactctatttaggaacttaatttaacatgtcatttactttgatatttgatttattggtttatttccttaaccgcaatatgagtccattcttcttgttttaatgctctatcctatttaacaaggtgggtttatttctttgcctcagaactgaaaatgacggttccttttcaccactaccaattttcccccttttcattttagctatatatatactatgatgatgccggttatcaacttatcatgatgcttttttcaagaggtttcacaatgataaaactaatagacagagtgctctggtagcacattgttcgtttcaccttgaactgtatcatattcaaatttcagaagctcacaagatatcttgctttctcaaattgtcaagagaaaaggaagcatgctaaacatgtgcaggttcctttattatagcttagaagcctgcagtatccaatgaacaaagacaattattctaacttttggttcgatagcgacctcagttctataattgcttttttcctgttgaagattgcattttgacatgttttcctccatttttgtgcttgcgtttacctgctgcaagctccaaaaacctgcatctctgtgttccaagttattctgtttaattgtgctaaacaagacatacaatgagaacggaccaaccgaccaagtttattccctccctgtatatgtatttgttatgatgtttgcataacttagcttcaaagtatactgtacaatgctgtaaatggtaaatttcctgtcttctcttacttttgcagtttctaccaccagatatgaagctggcaagcagaactgcagtagtctgaactggaaactgattgaagttaatgacaatttatgctgtgtcttttggctctccaatgctatgtaagattttccttgacatacatcggatcgagctagtgttctaggctcctagctgcaatgatatagagccaagataatggtccaattctgaatttagaatatcagaatttgatcttttttttgtcatctattaaggaagatacaataaattatggtacagagtggatgggctgccaggaagataatggtccagcaggcagcagcaaggttaaatcagaacatgagttcttaattcagattacctctgagcaatgctgtcagagtgagtcctcaaacttggcttattagatttagtgtagtaagtgagccacaccttctgacttctgagtgttggttcctactgttagtgctgctataaaagtgctattactgattcttgcactcactatggccagcaaatcagagataataaaccatgtgaaagcctcacgtagtgactggacatgacataagcaaattctttgcgagttgtctaaactactttactttacagggtacttatcgtcttatggattttaatcatcagtcgagaaaatgacactggtgggaactgaatttggagttttggactgctacaggagaaatacgaactttatgtcttatggattgaacagcaggaactgtctacaatggaaacagataaagttttctgccctggttatattatcatcataatatttcttcaggtattcagatttctttccttgtctgggtacaagaagattcttgtggaaggtactatacttgaacaagggcttactttttgggctttcaaaagttgggaggctaagggtggcctatcctttcggctacactgttctgttttcttttcttttgattcctcttcacctataatcagaaccgacactgcattcagctctgcaacctttgtgattaaataacttttgtgaaatgcttttgaatggaatatatctcagcatatcttaattctaactatttccgtatccaggttgaagtactttgcttgcctctggcagaggccactgatctatccgtggatgacaatgtgggcactcaaggtctgatcccaacacccccttcaatgttctaagaattattctttggcacagttaatctattgcgggtcagttatttttcatcaaaactggtactgctggcaagctagctatctgaacggtgaactgaattgtgtagtcctcaggggaaatatatcgaaagttgaagttctatagccagttacgcttattcctcaaattacattacgatgtttaagactatatgtcatccaattgtaggcttggtgtttaagaataagacaaaaataaagataggttgtgtgttatcatacaaaggcaaacagtttagatgtagctatcatagaacaggctctagtaaagaccttaagcccctaatcattagtttgatcagaacgtaatttgtctctggcaatctgtcatcattgttaagatacattagctgatttgctgggtccaggtgggctaaattctccctttatctgctcttattccttaaaagccatgtgaagttgtggagatttgtgcctcctttactaatcaagctggttgatcgtacttcaccatttcataatattaagtaaatactaaatcactgcacttttatattttaaatagattgcgtcatgtgtgtccttcctggtcactctaagctgtcggatcgaccgacttgttttaccattcatgttacattacattggacaccttgttcctttttcgtatcatatcgttgccacaaatcatagactcagttaaagttgtgccattattcgtatttactaatgtacttgtacatgatacgcttgaggcaggagggagctagatacgtagaatagcttccgatgggatggttttggagatactcgctatgtgtggtggggagaagcataaactcgaaaaggggaaaggaacctaaagctggggcggatggattgataaaaaggaaaagtggcccacaagctatgcatcagcagccgcaagttggagggcctcaaaagcgcccgggacccagctcttgcacttgccatgtaggcttagcagaggaacgtgtcgaaagcctggctatcacagtacatttgttggataaccaccttttctttttgatagctgctgagagatcgtcaccatcattggttcattgcatacctagctagaatgaattggagagtataattcgatcatggaccaaccaattgtgttgtccctaaccatagttcaaacgcatcctaatcagtgatctcttttattctgatatgcccatgtttgtaggataaaatggctcttttagcaggctcttgctgacttcagtaaaaggacggtggtttgtggatatattatatttactgaaaaccatagtaaaatgagataactgtgggtcaaatgtgaacgaaatcattttggtattagtgggtcctattttcaccttggatttctggttgctcactagatccaacagaagcctttttcaatcctttcagtgtggacagttgtgagcacaatctttagagcaagtttaatagtatagccaagtactagctccaaatcatctagagccaatgtaatagccaattcatacaataattgcttactatactattaatacccggtctcacctgtcatacactcgttacgtcttggagtccgtgctgcagctggctacagatctgtagcccgctgctcttccctctcttcctttatctctttaaaatatgtttatagctggtttatagcccgctattgtacctgctcttattagggtcctttgtttctggcaaatgggcttgccaaatttgtcaccttggatggatgcttgccaaactgtgaaaactgaacaatgcaagtgtcatttgattccttgatctcatggctgttgcatttttttagggtcatggctattgcattctagtgttatggctgttgcatttttcataatatatgttgtttatgtactattttaaatcgtaagccagctccttgaagtagttttatgagcattcaccaattatatcttgacttccactgcatgcatgcatgcatgcatgcatgcatgcacattcgttcagagtactaacctgaagtttgcacaatatacagaaatcaatcaaaatatattcaacactaacttttctcttgatagtatctccacaggtgaccagcttagtagcttactgtcggccagcaggctgcatccatcacatcggttaccgagcatggcatccactcttaaacacccagaacggaagaatgtacaggtaaacttgagctcagcattgtgcttctcagttgagagacagttaatcagctccttgacaaagtattagtactatagtacatggattagctgctaatcatgcagggcacacgcatcgaggcagggcccccggcaaaatctacatgggggcgcgtgtgtgaacgtgacgtaaaccgtcaaagggaagggggggaggctgccaggggcaaaaaagcgcgcgaatcgagtaccaaccttgggcccctcactctttccaacgagagctgactaggcacagccatggtggccccacaaagcaaccaatggcatctctccatctctggagctacagggcctcactttattggcagccaaagacaaggagagaagattgggatatttctctattcaccgctaaagctaactgacacaagacaacagaaagcaaaagcacccaaggtgagagagagagacatagagagcgagagagctgtacatggaggagtagtagcttcttgagaaagttggcaagaatccaaacatatacataaaatactctcggaaaacttgctataaagcacactccctcccgcagcccctttccctccctctcttgttcttcctctctcatgtgccattagccaatagcatcaaggtctcctctcttcctcctcgatcctcttcattttgtcttacttgcatgacattcttgttaactcatctatgtgttattgtatgttgcaggtttttgtacattgtagctgattataattcattcatatagctattcaaacaagttcggtggctgtccacattttagctttggatagccggcttgccagctgcctgcctagctctaagcatctcttgctgttggagttttgagaggaaggctagaggaagcatatggcgcccgtgagtttgcctccaggtttcaggttccaccccaccgatgaagaactaatcatctactaccttaagcggaagatcaacggaagacagatagaactcgaaatcattccagaggttgatctttacaagtgtgagccttgggatctgcctggtatgttcttagtttgcttgttctaaagatatctattcctagtttttatgttgcttgttggtggtagaagttagaatgctgtagcccatgctaggatatatatatttcaatccaaccctaggcccatgcagctatcaccaattggcgttcttatatatcattctcttgctatataggagtaacagtttctttctttttgttttaagggtaggaatagcagtttcatgatatataatttgtatgagacttttgtataaatgctataaggacaagttttaagtttatatgcatgttaaaattcaggttaacaattaactataggcaagcatgcacctttattgttctccaaggaaagcacatatataggtccagtatgtttattggatgccgtgttatgtagacactaagcaatcttattcaattcttatactattatgccctcccaagaaacaccagtgcctacactacttgaggaaagaataaccacatgttcccttcttgatgagcacttcatctagctatttgtagttgaaatgtatgtaataataatcactaattaatcctggctataaatgtgtagctctatctgttgttttagtttttcttttatttcacataagtagcttttatgtcatttatgtcacaaaagaaaaggtttccatgattaattcgtaaattttggtacatttgaattgctagttatatcaaagcatatttgattttttttctctttatatataaaaaatcaagcattgtcaaaagcgatgtttcactgtcatagctttgtgtgaaaacaagattaatcatactgtgaaatttgctttactttcaaacatcttatgcacaccgaaaggagggatattgatagatcttgatccttttgtcaaaagaaatttaccttcaaaaagaaacgtcaaatttctgccaagtgtaaaggtgacattatatacgtccatgcactgagatacttgaaatggaaaataaatcctttatatcagtaacatcaaagttaaagtttatatattttggaccatgtcacaatcacagagagatttgaggaaaagatatattctctctttatccacttgctgtttgctttcaagcttgacagtttactacaaaaacaccatgtagcattcaacattctacgaagcgagtgctgtaaaaatatcgaataaaaagagaaaataaagatgagccttttttcttggggtgacaaaataaagcaagaaactaagaaaggaacttgtgatgaacatataggtcaagaagatgaacaaaagtccgcacagcctccaagagatataaagtgaccttggtctaattttctttcagctatggtgggctatcatgttaaatagccatatcttaactctgtcattagatccaatcatgatagtagacaagtacttcaatgtttatgctgcatgcatgattatgtatgactttttgtttgtatgacaccccctaactgatcgttcaatattcagaaaaatcctttcttccgagtaaagatctcgaatggtacttcttcagccctagagaccgcaagtacccaaatggatcaaggacgaaccgtgcaacaaaagccggatactggaaggcaactgggaaagatcgaaaagtgaactcacagaggcgtgcagttggtatgaagaagactcttgtgtactaccgtggtcgagctccacatggttctcgcaccgattgggtcatgcacgagtaccgcctcgatgagagggaatgcgagactgacactggcttacaggtgtgttactattaatcttgttgcatttttaaatctacaaccataatatatggataaaccatatatgttatatttagcccttcttttctgaaattataaacctagagtaaaatatgttactagctgcttgacatggacgcggcctctgatatgcaacctctttgcatttgtgtgtctatatgtaggatgcatatgctttatgccgggtgttcaagaagacagcgcccgggccaaagatcatagagcattatggtgtggtgcaccaccatgtcgagcaacctcaatggatgacgagcagtatcgatcgctccccaacgttggacgtgtcgtgtgatggaagaggtgatgactttgagagcagcagcttctctttcccaacagagacgccaatggactccatgcacggtgggtttggaatgcagatgagtgcacctcacgaggatggcaaatggatgcagtttctgagtgaagatgccttcaacgccaccaatccattcttgacgaacccagtttctgccaacttctcatgccttccatccaaggtacatatacatatatagtcaaaaatgaaggttacttactggtacagatgacatgtatattcaggcaatgagttcttaccggtgcaatgatattcatatgcaggtggatgttgcactggaatgtgcgaggctgcagcacaggctcaccttgcctcccttggaggtggaggatttcccacaggacgtcagccttgacacgaagattggcatacttcgcagtaaccccaacgaagttgacattctccaagaattcctgtcagttgcgactgcctctcaggagctaattaatggctccaccagtagctaccctgaaatgtggttaggagctagcacaagcagtgctagctacgtcaatgaactgtcctctctagttgagatgggcggcgttggcacttctaaccaccacgaatccgcaaggctacaggtcgagatcgctgacatggaggtgttcaaggacgagaagaagcgggtggagaaccttagaggagtcaagttggtgaacaatgaccttggggaggtaattgtttgcatcatacctatacaagtatattcccatcattatatatatactacatctcatgagactgattactttcatgcttcatttgtctcaagcagattgttgtagaaggagatgaaagcaatccaacagaagacatcatcgcgcagtaccctataaaagtcactgcagataattcaggtatgtaatatttaattttggctgttttacatgggctccacagaagtaattagcagtattccatattcgatacagactgtatacagatacagttcttgcatgcactaactcagagctagattgcaggagaagccggtcatcgcatgaccgatcccactgacgtaggcggcatcgacactgccccgatcttctcgcaatctcaacctgacgactttgctgctggtttcgacgacgtcaaccctaatgcatctttcgatctgtacgagaaggttgacgtcaaccacaggctattcgtttcaagggtcgctgcggcgaagacattcttccaccgcattgagccatcgaagaaggtcagcttccactcgaacccggcagcaaccgccgtcagtaaggcgaccgagaagttccatttccccgttacgaccaaagttagtggtagggtttccatttttagcaagttcaaggcactcataagggacaagttcttgatgatgaggccatcacattcataccaaaggttgggcagcaaagaaaccacagtgaatgagctgctgcagattgtgtcactccttttagcaccgaagcaaatcaatggctgccctactgagcaagagctggtcaagaagaaggcgaaagaagtgatgaagccgggatggggtcgtgaagggagcaacaaattgtggcttccgctctccaaagggaagggcatttccagcatgtttttgagtgggaaatggacgtttctaacctccgcgttggccatcagcactccagctgagtgcgatcactaaaaggtcttttccatgactgtcaattaatgacactactgttatataatctgctataacctcagtagcgcgagcctagctagtgcatgaagagaaggttaacattaattaactgtcttcgtgtctctgttattaactggtgtataactggagaatgtatgtcaattaattattatttgttcgtcgtccattctaagtctaaccctgttgtatcaaaatactatcgttaatttgtaagtgcaaatacagatgtatacatatatatacatgtaaacacacataatgttcaatattaattgtatttgtttcattcacggtggcggccaatttgagctctgaatgtcgtgataatggttggcattgtatttggcggtctactgaatgagagatgccctcttggtcaaagctagactcacattgactgtagcatgtttgatcttagctagatgtactcgtctgcagcaagcggtgcagatgttctagtgctagtgcggctgatcgatttgtttggttttcacgattcgcacaccacacacgctgccttacatggtgcggcgagccggcgatgaaccttaagctagcaaagctggcagctcttcttccaaatgctactgcacaaagttaagaaaacctatcctatcagcaatacaactgtaaactgtaccagactcatctctcctaggaagtggatcctcttaacttctgttcagggtgcagcgtttccaccacttcgccgccatggagatggacgcagagctgtggcgcttaaccccgtccgagaaggcagagctaagccatcgccgcaggccgaccatggtatggtggcaagcagatcggagcaacgcgagccaccattggggggtgaatttgggggcggtggtggtggcggctcccgccccagagtttactttaccgccagtaaccgtgcggttaccgcggttacgggcttatcgtgggggcacggtaatataaatactatggtaacatctttaaatttaaataaatttaaaaaaattaaatttttgataaaatttgcacggcttttcacggttacctaccgtcggggtacggtaaacccggtcctgacggtttgggaaacctggcccgcccccgcgcgctctccccgacccggagtccacgcgacgacacgcatatatcgtctttacgagccatgagcctatgacacctg

SEQ ID NO: 728 - DNA, 8108 bp, Oryza sativa
gtcagccggccaggagggcgacggatctggtcaaggggccaccgccatcaccggatccggccgccgccatcaccgggccgagggccaccaccgcctcgctgctgcatcgccgatcgagacccgcgtcctccatcgctgccgctcgctgcccctctctgcctccgtcgtgtcgcccaccgcgctggcccgcaggtggggggccagatcctgccacaggggcgccggatccgccgccccaagctgaccggccgactccacctccggccgtgccatcatcggccatctccgtcctcctcacgcagagggcggttccgctgactcgtatgggcctcgccgccgccttcctggctcaccgccggctttgccgccgccgagctccggcggtggcgaggtggaggatggggaagaaggtgtggcggcgcgggcggctagggtttcgcccccgagccgcccgcgtgagagcgacgcgggggtcaagactccgacctcgagaccctaggacagaatagacttctccattaagcctagatacatatttaaaatgtactctcttaatgacctgtttaattcatattacatagaaaatatatttattatattttaaaacagatctggtatataataccaactcgatgaagaacagaagtaaccgtaagccggatgcgactatgcgagcagtcgagcacgcagagcaaaactgcacaaagtacggtaatacccacccctcaggtcacaaaccagctaagccccggatacccccaatcgtaaatatcccaatctctcgtgcccaaaaccaccacgacccaaataccggcccgcacacaaatacaccagcgcacaccaccaggcaccaggagagagtgtgccagtaaaatccccgcgaggcgcataggaaagtacgagactacccacgcaagcgtgcggaaactacgatccggacccacacccaccctcccctcagccctaaaagcacccgggataaaaccccaccctcctcccgtcgtccacgcctccgctcccccttcctcctcctcctcccctcctcccctcgcaaacgcaaccttctctcgccgaagagggagaagggaaaaggggtttcgatttctccgcgatttccccgcggattcctccccccaccgcctcgatcgagctcgcgcgcggcccccccggattcggttcatccccctcccatccccccgtctgagaagcatggagaaggatcaccagcccgtcatcagcttgcgccccggcggcggcggcggcggcccccgccccggccgcctcttctcccccgccttcgccgccgccgcctccggctccggcgacttgctccgctcccacgtcggcggcgcatccaaggtgagagggggggatgatgggggatgagagcttggacgcgcccgatctggcggcttgatgtactgctcgatgtggattcgatgggatggtggcgggcgtgggagggggagatccggtgagaggatcggatctcaaatcgatgctccaatctgggaggggcgttagtggttgtagttgattatcgcttgcacggctcgacctagttttaggagggggttaatgcgagacaaggagctgatagtcccgactgtgatatgacagcttttgctaattaaagttggatatttcatggttcagcatgctatacttaggatttgtagtggattccagtgttgttttagctttcagggcttctattgctcttctatgtggcttgtgcgatacaatgggccgtgcatataagttaactgagtctgccttgttcttcggcaagtttcatacatatatatgtttgttttaaaactgcaaacagcatttatgtattgcatccttagctgaatcaagcaagttgttgttgtcgtgggtgttatgtaatctttatgtcaaatatttttttgttggatcaatctctcagattattagccaaaatgttgtgtcctgtgatttaatttgtggagttgtggacttgtgttttctaatttgatatgctgacatggctgatacttttgctgcagattggtgatccaaattttgaggtgcgcgagcgtgttcgctatacaagagatcaacttctcgaactgcgtgaggtacttgcaatctgttgtgttattcaatatcagtttctggatgggaaatttgctgtgaatatcttagtagacatgttctgctttacgtgctccctgtcgtttggttttgttgaaaaatgcttgcagcgtatctggcacatttgagctaaattagagcagaagtttctatttggaatacttttcaacacatcagacatggaaaacaatatcgcgtaggtggtgtttctgcaactaggtgcatagcacacaaacatcgaaatataccacgttaatgtcccctaggtattcgtgcagtgaaagttgaaacacaaccaactttggctgcaataaatgtagaagtgtctaaattggccacattgaaatggttataacagaaattttgctggtacgagtacttcgatggtatgcgttgctagcatatcattggaaatttcagtgatgaatgatttaactttagactatgctatatacaaagtagcaccgatctaggatggaaatagaggcactcacaggatatttaagtgaaactgtacctactagcctcaagtggaagagccgcagctttctttcgatataagttttggttacttgtttactctgtagtcttgaaatgcaataaaagagaggggggggggttgagttttagtaccctattttcgcagttcggtcgttctgttttaacctggttttataaatgtactacaccttctattgagacaacattagacagtgtctaacattcaactggcatataatatttatattgcgaccttgtgaagactactaattttttgcgtactaattatgattttacttactaacagatcgttgacatacctgaggccatcttaagaattaatcaagagattgatatagagcttcatggtgaagatcagatttggggtcgccctgagtcagatgtgagctcttgctatttccgctgtcatcataattcacttggttttaccatacgtattaatcaatcctaccaattggtctggttgaagcatacaattctgtctcaaattgtagtcttttgttgttcaggtgcaagtgcagacacaaacccaggcgcaaccgcacaatcggtatggtgagacagataaccgtgactggcgtgcacgcacggttcaacctccggcagctaatgaagagaagtcctgggacaacattcgtgaagctaaagcagcacatgcttcaagtggtcggcaacaagagcaagttaacaggcaggatcaattaaaccaccagtttgcttcaaaagctcaggtatgttcaagacaagaattatcagtaaagtttgttccatttgaccttattcattcattattttttttcatatcttgaataagctcatatttcttcctgcgctaaacaatgttgcttttgaagtagccttgcttagtggtagctactgattcggaattaatgttggttccctctgttgattatgtctgatgtaacctcctcggttaatccatggctattattattcatcaaattactaaactaactaggttttgccttttgcgggatcgtctacccaactcaacagtgttatttacacattttgctgtcccctcattcacaattgatcactagtgccatctatgctcttttaaccctatctttcttgcaatgaatgttgaaatgtaaaccacagaagaagtgtcgggttataaattggtacagaacaatgtcagtttgtcttgtatgtgacagtccatattattttgttgtatgaaatcaattcacatgttttaatatgtatttttctttcataacttgtatacttgtatgtatttgtgactttgtgatcaggcctttgctgatgtatgtctttcaggttggcccgactcctgctcttatcaaggctgaggtaccttggtcagctagaagaggcaatctctcagagaaagatagagtcctgaaaacagtgaaagggtatcataattatcgttcagtctttttcatgtttttgttcctttttgagtgcttttatttctttatttctttatttctttataacacagttttctggcattgacttgctgcctgtttttcttgtgcgtatgcagtatactaaacaaactgacaccggagaaatttgatctactcaagggccaactaatggaatctggaattaccactgctgatattctaaaggttggatgattttagatctcttttctgtagctttctattttttgctagcctccttgtgattaatatatcttctgcttttgattcaggatgttatttctctcatatttgagaaggctgtttttgagcccaccttctgtccgatgtatgctcaactttgttccgatctcaatgagaagctaccatcattcccttcggaagaaccaggtggcaaagagattacattcaagcgtgtgctgttgaacaattgtcaggaagcatttgaaggtgctgagagcctaagggctgaaatagcaaaattgactggccctgaccaagagatggagagaagggacaaagaaaggattgtcaaactaagaacacttggaaatatccgtctaattggtgagctacttaagcaaaagatggtacctgaaaagatagttcatcacattgttcaggtatgcattagcaaattggtaataaagttattattattcaggggtagcttgtctaatctgttctatatgcaggaactcttggggtctggacctgataaaaaggcttgccctgaagaggaaaacgttgaggctatttgtcagttcttcaatacaattggtaaacagcttgacgagaacccaaaatctcgtcgaattaatgatacctacttcattcagatgaaggagttaacaacaaaccttcagttggcaccacgtctgaggtttatggttcgtgatgtggttgatcttcgttcaaacaattgggtgcctcgacgtgaagaggtaaataaaatcaccctagtgttttattttagttatcttttatacatgcattgtctttctttcataatgacgttagtctcttggttgtaccgaggtgctgctatgagtactttggtcaatggctaccaaattctagcaccatagttatctgtagtggctctttaactgtgagcttattagataaacatgcatgctcatgtgggaatggcaagcaatcgccagtgctatgaaattgcatatatttatttagaatcaacgggtttgtctattgctttgtacacccctatattaataagagaatggccatgtttataatccatatttgaaataattcatcagttcaccgttttgactatacattgaagcattctgtttggtaccataatgttgtttctggcttacactaaatttaatgccaagtatggcttcaatgtttttgttcccactcttagtttgctgtttgtattagcaatcactggttagctggatttataaatttattatccattctgagttttgtgatgcttgcaatcttcagattaaggccaagacaatcagtgaaattcatgatgaggctatgaagacacttggactacggccaggggcaacaggactcacgaggaatggccgtaatgcaccaggtggtcctctttcccctggtggattcccaatgaatcgaccaggaacaggagggatgatgcctgggatgcctggaacacctggtatgcctggatcaagaaagatgcctggaatgcctgggttagataatgataactgggaagttccacgttctaaatcaatgccaagaggcgactctcttcgtaaccagggtccgttgcttaataagccatcatctattaacaagccatcatctattaactccaggcttcttcctcatggaagtggagcactaattggtaagagtgctcttttgggcagtggtggtccaccatctcgcccttccagccttatggctagtctcactcatacaccagctcaaactgcaccatcaccaaaacctgtaagtgcagctccagctgttgtgcctgtcacagacaaagcagccggttcttcccatgagatgccagctgcagttcagaagaagacggtatcccttcttgaagagtattttggcatacgtattctggatgaagcacaacaatgtatcgaggagcttcagtgtcctgagtactactctgagattgtgaaagaagctatcaatcttgctttggataagggtcccaacttcattgatcctcttgttaggctgctggagcatctgcacgccaagaaaattttcaagactgaggacctgaaaactggatgcttactgtatgcagccctgctggaagatattggtattgaccttcctctagctccagccttgtttggtgaagttgttgcacgactgagtttgtcgtgtggcttgagctttgaagttgttgaggagattctaaaagcagtggaggatacatacttccgcaaaggaatttttgatgctgtcatgaaaaccatgggcggaaactcttcaggtcaggctatattgagctcgcatgctgtggtaatcgacgcctgcaacaaacttttgaaataatagccccttggcagccttggcatatcaaccttttggatgctgtgcctagccaaaacagcatcgtgtattctctatagcttaggtgtttcaccccagaggaactctcgtactggagatgtgagcaacagccagttttgtgctgtatatttttgcaaggtcagatgagtgttcattattgtttcgacaacgaaggaaagaaagaagccatggattttgctatcgggtgacagcttaattcgctggagcctgagatgaacaaggcttaatgtggtatttttgtgtccctttattagttcttttctgtgcgtacacattttgtaacaatgtactatggttttggagtattctgttggtttacaatatatcgtgtcattgtagcggtcaaattttgatacctaattctgaggtttgcttgagcattcgtgcctcgtgtgcgatgaagttttatcattttcctcagaattacttgctgatgcatttgactatgattctgtttgtgggctgcctgcttgtgcgtgacattcttcatactatcaatataacaagagagttcacatcgtctcctaagctaagtttcctaagggctagtaaattggccttatcaatttttggtaagttttggaatttttgtcaatgctaaattttggtaagttttggaatttttgtcaatgctaaattttggtaagttttggcatgacaaattttaggaaggcaaagttgtgctaaacaaaaatagcctaagttaattattgaaatggcctattttcttaggcattctaaaatttgtcttcccaaatagacactacatactattaaaattgtcaaatattggtaagtaaaatttgggcctcaaaccaaactagccctaagttcagttttttttacgaaactagccctaagttcagttttttttagaaggagagatcacatcatggcctattttcttagacattctaaaatttggcttcccaaatagacactacacattattaaaattgtcaaatattggtaagtaaaatttatgcctcaaaccaaactagccctaagttcagtttttttagaaagagaggtcacatcatctcttagattaagttttttttagaatgaagagagtacggcatacatttcaaccaaaatttaaatttagataatagtactagacaaagcgctagaagccttccgtccctatccccccccccctctctgttgctggagatcaaaatcgaatcaattgcaaagctcaccgctcacccacccaccccctcgttgcgttgctcctaagccaccagacgcagccctgcactgcagcagcagcagcagcagcattagtctcgtgtgcttctcggcggcgagtgatcggctccaccacctcccacttccctttccccttcgttgtcacgcgaacgcgagcgagcaatcgaatcttcctcgcgtaagcgtaacacctctcctctggtcttgctccgcccgccccgccccgcccgt

SEQ ID NO: 729 - DNA, 10355 bp, Oryza sativa; identical to SEQ ID NO: 417

SEQ ID NO: 730 - DNA, 4266 bp, Oryza sativa
caagccaaatcaggattcagtgaacttatttgcatgaaagccaaatttgggcctttttgcttgcctgcgttttattgggctccaaattttctacagcacatctccaagcctctcaggccttttctggccaacgctcaaatctcggcctaatctctaaaagatgggccgtaatttcggccttccaaaacgacctcgaagtttattgaacagaaagttgaaagttaaggtccgttcagattgtagccaaaataaacctagcaagatggtaatattatcaaaattttgacatgatttcttatttatttagcaaatttagcaacaaactaaacgtagatatttttttgataactttgctaaaaaaatggtatggttgaaaatgacgtcaaagtgaacagatccttattttaattgaactattcgtactaagataagctgtattgttcaacaaattaatgggagacctacactttgattgattgttattgtatcctacaacgtgtaagtgctctatgttttttttcctccactacctggggtatatttatgggttcaaattatgccatgtattcaatcatatcatcagttaaaaggaggttggcttcgataaaaaaaatggagaatttcatatggaattgtttgtgactgacactggtggagatgacggctggaatcgaacagcaagccgatgatatagtatttccaccaaacaaaaacaaatgaaatttctgttgacttccaaaatgttgatccattcatctgccagtgagctggcaaaaaaaatacagccaaagcgacttattcaattcagtttttatttctcccaaaaataatgccttactgaattttagtgtctaagacttgcagtcataatcctataaataaaacagctataatggtttttaaaggaaaatgtttatgagctcatcaacttctttcaagtccctgtacttgataatgagcataaaatacttgaaactgcagaaaagtttagttccatgtccacacttcagtttcaatgttaacaaaaaaaaatataaaagcaaagtcaaatagcatccagaccgtccatcctaccgacggctgtgatcacttgatcaggagcagtctcgttgactttgctaaaattttattccaatggtgttcctcctctcactcccagatggaattctatactccccgaattacttcctgcacaagtgaaggacccaatgagatttcatttgccatcatataatggtagtattctcctcctcctctataaaatctcaccaagatcttattcataaactttttcctacgccaccatttcttgcaatcttgcagcttttcatctcttgttcctcctagattttcatagagaaatctgtttcatccaatcttacaaagctccttttttttttcttttttcattttcttggtcaaatttgttcttcatctttgatcaattcagttactatttactacctatgatctgctcatttctgctagaattcattgatttctcagctgaaaaacactcactgttccattgcaacaccaagggtgcttgaattttactcggttttcgccatggatggggtggaggaggcgaacatggcggcggtggagagctcgaagaagctcgtggccatcctgtccaagtccggcgacccgttccggctgatggcggccgtcgcggagaccgacgaggcggtgtcaaggttcggcaaggtggtcaccatcctcagcaacagggtcggccatgcgagggcgaggcttggcaagaggaggagctcgccgccggttgatccgggctgcctcatggaccacccgttggcggcggcggcgagctctcctgctcccagcaatggccgcctccatttcagtagtagtgctgctactgcgtcgccgtctccggcaacggcggcggcggcttcctccgccgcgaacgtcacgccggcggtggttgaccggagcttgtttcttgagacgacgctcttggatttgaacagtcgcggcgctcctgctccagctgcatccatggcggcggctgccaagaacagctcgaagcttgcacctgcacccatggtgaacagctcctcctccgcaaatcacatccagttccagcagccgatgaagagctttcagttcgagcagacgccgatcagcgacaagttccacatcgagatgccgagaggcgtcggcggcggcggagggaaggaggtgatcagcttcagcttcgacaactcggtgtgcacctcgtcggcggcgacctccttcttcacctccatcagcagccagctcatcagcatgtccgacgccgccaccaactccgccgcggctgcggcggcgccgacgaccaagaagccgtcgtcgtgcgccaggaaggccaccgccgacgacgacgccggcggcaaatgccattgcccaaagaagaagtccgtgtcaatctcgccaccgtttctcggccatttctgccatgatcttgaccgtgttcttgcttccgatttcttcgcaggaaacccagggagaagaaggtggtcaccgtgccggcgatcagcgacaaggtcgccgatataccttcggacaattattcttggagaaaatatggtcagaaaccaatcaaaggctctcctcatccaaggtagtaaatctcactactaagaacaattaatcatctcaaaattcagtcatagcttcataatactcgttcatctcagttactgctactgatcaacttctttgcaattccaattactatgatcagtttcaacttaagacaagaataaccatctcattatcatctttaaaagacaatagctaatgatcaacttatctgtcatgcctattaatacggccacttccaactgatctgcaatctgtaccctgtactctgcttaatcatgatcaaatgttcagatgaaaaaaattagacaaatttgatgagattgattgtgtttgggtttgatgcaggggatactacaggtgcagcagcaagaaggattgcccggcgaggaagcacgtcgagaggtgtcgcagcgacccggcgatgctgctcgtcacctacgagaacgaacacaaccacgcgcagccgctcgatctctccgtagtgcagcaagccaccgctaatccccagacctgatgatccttagcttaatcaccatccgtgtatctatcagcatcactgcaaatgcaaatgcaaatgcaaatataggattctggaaatctgaacttgtccatgaacagctacttggtaatatcaaatttgtgactagcttgttatgtttgatcatgtacgagtagtagctctaaaaacgtataaatgcggacgctcatataaaagtgcacactcacaattatgaacacacatacatatatacagattaacgaagccaccaaatacgtctatcatgtttaagtcttaacagtttctaccacatcaaaaccagctgagttacgctcagttcgcactcactgatttctctttctggaagttgcaacgcacaattcgtcaattcctagtgtgtctctttccgtctgatgtgtagatgtcaagcatgagtgtggttcgaggggaatgaacagatctaaactgctgaatcattgcaaattctagatgcaaacatcaatgattagtgtggctaattgcatttcgtttctgagagatcaacgtgcggttaagcgcgtttcttgggcccttattgtactctgccaccaaccgattcatgtgatctgtttgttactgatgagtcacgataacactgacacttcggtgttttgagaaatgtgtttttctgccgattcctagagaaaacgaaccgtttctcgtcaaattcttgcaaattttatttgaaacttaacccttaaccgaattataaatgtagatagctggatactatcgcattctgaataatacaacggtgctgggtggttgcatggcaagcattggatagccttaatctaatttgcccaatagacttctatatttttttcaatacaggttatacagcatatagattataaaaaaaaacacaagtgaatcacattgcagccgcaaaccggccctaaatagctagattaatatccaaatcaagatactaaacacttgctcatgctaaattccaaccctagatcaactaggttcatcatgtgaggtgatctacctggagctgcttatgacacccacaagagaaactagctggaaacattgacaaaatccaatttaattccatccaggcatggtgttttcacagatgaaacatatatattcagttaaacaaaaagcag

SEQ ID NO: 731 - DNA, 3976 bp, Oryza sativa; identical to SEQ ID NO: 714

SEQ ID NO: 732 - DNA, 4843 bp, Oryza sativa
cttctggtcagtaacctaattaagatcgatctaacaagcagagttaatgttgcggcaacaaactgacatatccctttcttcaagttacctctctctaagaataggcatattatggtttaattagctagacaagaaattagttaaggttcttaatgaagattccgtcacttttgctagctttgaaaacctgcagagtgaattgtgcaaaacatcttggcatgttggtgttagtggtacaacagatgctgatacaaagaaattaatgctgcaattgttagaagctcttttttttctctcttttgaacaccaaagcactttgttcatggtgaaagggactacccttctctttcatatgttcccttcttcctctgttcttttcatgagatttatttgatgacttccctctgctctgttattttcatgttctttgataaatgtgctgattgtattatcagtgttattgcactcaattcattcttgaacagtgtgtgaattaactctttgttcgatttgagcttagtcacttgattgcacacgaactactctgcaattcttttctgacgatagaagtcgattgatggatcacccaacatgttactaattaagttgcatcattgtccatggttgtacatccttctacaaataaaactacacaaatcaagaaaattttcaataacatttcaactattgtaacaagtaaaagaaacctatatgagagctccagctctccaaatggcaacagacacactgagtggtcatacgtgtcatattgcccctcagttatgcattcatatgaccacatattcagagtagtggagagagggacagatctagaggtagaaaaagaaaattcatataaatgatatatcagagtgaaaaagaaatatcaagcacaagaaaaaaaagcaaaggttagatatgcatctccccctactgtacaccaccaaaagtggagggtctccaactatataaacactgagccatggccaaggccaaaccacacatgcagttgtagtagcacttaagccttcctctctagctagcatctcttgtgtcaggaagttggaagggatttctggctagtttctagctggtgtctcctctcctcttcctaaccttctcactgattaacaccttagagttagttaataaccttcatcaccagtagcaatggcaggaggtttcttgtccatggctaacccggcggtcaccctctccggtgttgcaggtaaagcatgcaaccaatgcataatgctcaaacttaatttcatcatcatcatcatcatcatcatcttcacagccatgatcatccatggacaaatgcaactgaagatcattttagttttcatatgctaatgatcaaattcaggttaattgctgtttaatttctccatacactagttgttgtctgcaccattgcattgtgcacagcacacacacgcttttgatgcttctaggaatgcatatctgttcagcagttcacacagtgcagcagggcaatgttgttaaaaaatcttctccttttttttatgtccttgtgttcttgagctttctgtctccattgatctgcttttttcttgtttacaagtgatgggcacaagtcacttccctagcttcagctcatgcatggagcaggaatctcacttcaaaagacctagcactttttctctcttcacctttttgcctcaacacatgcccagtttctggccacacaaacataaacacatatactatctagctgcataattgcatcaaattaagcagggtttgtttcagctaggaattccacacataggtcattaattagtattgccaactttctcaacatgcatgcactctagtactctacctaagctagctcccagattagcttctgctaatttaattccgatttcttgaaatggagatcggttgagcagtgagggaggcgtgcatctgctcctcttcgtcgctgtcactaaacaaaagcagagctagctaggtggtaacaaactgatttgatttttgtcagtaaacaaaaatgaccaattaatgacccatcaaccagtttcaattctcgatcctaacctagctaacatctctgaaactctgaaagaacattactatcttactgacagtgtatatatatgcaaactaaaattttattttattttatcctaacctagctaacatatctgcatccgtgtgaaccagctgaaactctgaaagaatgttactccactgatcatatattaattaacgatgtcgttttctgtcttgtttcttttgcaggaaacatcatctccttcctggtgttccttgcaccagtgtgagtactccattcctactgtcaccatcaaaatctcgagagaaacatctgaatatctctgacgacgaactggaatttatatctctgaaaaattgcagggcgacgttcttgcaggtgtacaagaagaagtcgacgggagggtacagctcggtgccgtacgtggtggcgctcttcagctcggtgctgtggatcttctacgcgctggtgaagaccaactcgaggccgctgctgaccatcaacgccttcggctgcggcgtcgaggccgcctacatcgtcctctacctcgtctacgcgccgcgccgcgccaggctccgcaccctcgccttcttcctcctcctcgacgtcgccgccttcgccctcatcgtcgtcaccaccctctacctcgtccccaagccccaccaggtcaagttcctcggcagcgtctgcctcgccttctccatggccgtcttcgtcgcccctctctccatcatcgtaagcttaagctctctaccccccctctacatttcactgacatcaattgcattatgtagctgagcatttctgttgatgatgatgatgcttgcagttcaaggtgatcaagaccaagagcgtcgagttcatgccgatcgggctctccgtctgcctcacgctcagcgccgtcgcgtggttctgctacggcctcttcaccaaggacccctacgtcatggtgagctcagctgccgccattgatagagctgctcgacgacgccattgttgtgaattgttttgagctgacttgcatttcttggtgcgatgcagtacccgaacgtgggcggcttcttcttcagctgcgtgcagatggggctctacttctggtaccggaagccgaggaacacggccgtgctgccgacgacgtccgactccatgtccccgatctccgccgccgccgccgccacgcagagggtgatcgagctccccgccggcacgcacgccttcaccatcctgtccgtgagccccatcccgatcctcggcgtgcacaaggtcgaggtggtggccgccgagcaggcggccgacggcgtcgccgccgccgccgccgccgacaaggagctgctgcagaacaagccggaggtgatcgagatcaccgccgccgtgtgacgacgactgatctcgacgacgacagattctcgctactgatgaagaagacgacgacgatggccggatcgatgacggacagaatttagcagtgtggattactaccgaactttaattagttggttaattattggattacaatgtggtaagagtgtgtcattagcagctagttaacttacttaaattaattatcttgttcagtcagtcagtcagtcagtcagtcagtcagctttgagtgagtgagtgagtgatctcgacgtagtttgctggttggtgtaataagaaaaaggcgatctactagtagtctactagctagtacgcatgcatgtgtgtgtgctctacttaccgtgttgcaatctcatctctttgtacttacaactcagaaatcaatggaagattgtgacaggtattattagtagttactatactctgatacttgttctttaatcattaattaattaaactgttcttttgataattagtgactagtaactactatactactcatcagaatccatgttgatgttcagtctaggattatatattaatttatatatagctctatcagctacttaagccctaaatttatgtaaaatttctaggaaaaatcgtgggtgacagaggactaatcatggttcaatcttttgttttcggtatttgtatcggagagtgctgatatggcgaaattttcgaaattatataaattagtaaaatttgaacaaatattaccaaaattcaagaaaaattaaaaaaataaaaaattcggccgaaataatatcgtattgggaggttccgaaatgactggaattttggaaatttcagtccgaaattttgattaatacaaatgtgtttgaacagggcagacaatgggccataggacatgatgcatgttggaatcaaaatgacgtaggcagagttggagtagcaattagcaggtagtgtgacattgtgtgttctgtcttttgcaggcgatagaagggggcagagatgctgctgccgcagaaacgatcatcgatgatctcgatcggtgatgaactgatgatggtgataggtttgggttagtgaattggcagatggatggatcgaaggaggagaatgacctttcgtccgttgattgggcggcgggccagagcatttgcatgggaacttaattggagtggatggtgagccggggagacgacatctctatcgatctccatctcgaagcgatgcgatgcgatgcgatggatgccactgtagtgtagcagagtagtgtgtgaatgtgtgcggctactgctactgccggccgccgccaaccgccgcgccgtcatcggggaagacacgagagagatcagctgtgcgtatgcttgggccggaattgaatgtgcgctagttgggccgtgcataagcattcaattccgttgccacctgcaagaaacagatgcc

SEQ ID NO: 733 - DNA, 3896 bp, Oryza sativa
ttatcatatcagttcattttggtaatatcaattgcagttgttgcacgaaaattagtactacttttgtcacggttaaaatttgcaggttacactacaatgaattcggaaaaatttaactagaacaaatacttcatatgaaaaataggtcaatttctttaaaattcccatgaaattcgtccaaatcgaataggctctaaaattatatagtgcgtttcagacggtgaactcaccacacacaacatgtcatttgttctacatggatttatagccgaccgtatgctttctagagttaacaaatacttcctccgtttcacaatgtaagactttctagcattccccacatttatatagatgttactgaatctaaacatatatacgtttctaggtttattaacgtatatatgaatatgagtaatgctagaaagtcttacaatataaaacggagggaatacaatataaaatgttcgccgattttatttagacggtacgaactagtcaatgtcacactaaaataagattttatgtgtagccattgcctatttacaaattgtaatatcagatagaaacccttcggtgtgttcagcaaatgggttatgacttatgattggtgggattgagaagaaaaatagataaatgtttaggattaaatgtgttgtaaagaatagatgactaagatacagtaatattacctttagagtgtctgatattattctcctgtcctatttaccaaacaatccctttgagtgtggttttcagtaaccctacctttttttggttaaagaaaaaaaaatgaaaactaaggctgtgtttttaactggatccaaagtttggattttgattgaaattgaagatgatgtgactgaaaagttgtgtatgtatgacaagttgatgtgatggaaaaggactgaagtttggattcaaattttggatctagacacagcctaagtagtaggagaaacgtggttggtcacgatgtgcatacgcctccggccttccacatccttccagaaacgagccggccggattgctctccaagccaaacacggcccagagaggcgagagcccccacaccgccaaacccgacccggaaatcaactgcacacgctccgatcccctctctccagatcgattcggaccccatgggttggcgttggcacgacgacggcgatgacggcggccgcggcctgggcgacatccccgacctcgccggcggcggcggaggcggagatggggagcgctgcgccacgcgccgggtggtgcagtctcggtgccacacggaggaggtggagcccggccgcttcgtccgcaagtgcgagaagaccgagcagctcctccgcgactgcgtcggcaggtatatacatatactccatggcctcgcgcttttccctgatctgttccttcttttcctgcgaggatcccctctttgcatattactgttcgttgttttagtgatgaattggtgataacatgtcatgcgcagttgtgttactattagtcccgtgtatgattgtgagctgtgtatagccgcctctctgtggacgattttcgtgagtctgtcctcgctgatttgatacaaacacgaattcattaagaatggggaatgtgccgtgatgatcgagacgtttgagttctgtggtgaatagtatgatcaaatgtgtgtaataacttgggcttttgaattttggtagctaattagatatggaatttctatccagttttaggtgcccgtgccatcgacatgggttaaaagttattgtgggctattttgcgctcaacttgttaatcaacaaattttggacggaggcagtactttgtaggcatggggtaaatttgtatgatacacttgttgcttgaagatgttcgtgaactcatgggatttctagacacctacaaccaattacattacagtgttattatattctaacgatatgtaaagagcagctgtgttcgtgttgtctacactaaagattcaacaactagtggtcatcatcaaaccgatagcatatcctcattttgcaggattttgaaaactcacatctcgttagcatccttccttttatttcttcacatgcctcatgttaaacttttaagtgcatgaaacccaaatttctgtatttcgtagctccttgtaaccaatgtacaacactatgattagtattctggatagattttgtacttcccaaagtattttggttgttgacaagctattacaataatctgatggataacctaccatacattatttctcctaaccgatcacaataatcttcttctaggccctctgaactggtggaatcaaaaactgaaaatactgaagaagacgtcacagatgaaatgaaaagcgggtcactatctcttggttttccgaccaatgagccctttgcatttcctggacttcgcagtgacatagaagctcttgagaaaggccttttcgggagcattggtagctttctggatgatgctgagaggatgaccaatgatttcttgaagtcttttggtgtcccttccatcaatgaaagggagtcgagctcatttgatggacaacctacaggcaggcacattggtggacaacctgcaggcaggcacattgaggaaggtactgcaaaggacactaaacagaacgactacgcagaattcagcagcaagattacagatgtgtaaggatctacagttagctgacgcacctttgggagcagcttgccaattttgtattttgaacatctccatggttgtaattggaaggggaaggatcagtttgactgttttataagcagagtcgtctgaagtctgaagtgttgcgcttataagaacaattgtgtatattactgttttagataagcctgtttgtgttcctcaacaatgagatcaattatggatggtttttttctctgcttaagtttggtcatggataatgcaatgcattgttgtttctgcgttctgctgctcttggcttcaactgaaatatttgggggccaaaggggcagagactctggcaccctgatgcgcgattgcccatgcccatcctagctaatccatttgtgcgttctttcaaaggagattggggagattgtgactcgttttccacgcgcacgcttcccaaactactaaacggtgtgtattttgcaaaaaatttctatatgaaagttgctttaaaaaatcatattagtctatttttaaaatttaaaatagttaatacttaattaattatgcgctaatgacatataagtctcttcaggatgggctggggcctggggataggaaattctccgatcccctgtttttctcaactttaccttcacgtggtcttcgaagcaatttcaagttgctatgatgcttctagatatctgaaatatggacctgcacagtgtcacggtgaacgctcctctgatatttcggtaaaactacgaaagctcgtagctacttcctctctcctaaaacaaatccactcttagcatcctatcccaagacaactttagttgtaaggataaaataaacaaagtgtcccttatttataggaaaataatattaatagatggataaagggtattaaaatatggtgagataatcccttatttctctatggtatatgagctgcagatgctagatgcctggtgaggtatgtacgctttcttattatgaaacatgtatatcatctcgatttttcgatgtttctatgccaataattcgaaacagaagatttctcctccgttcatttgaaagtctggtttcagacgtaagctaccaaaaggatgaaattttttaagataataccaaaaggatgaaatgcttggtaactcgggctaggtgcttagagtaaccagaacctgcacactactttatcctacgctttctatataagtacaaccactaactagtgaggataagacatcatcaaa

SEQ ID NO: 734 - DNA, 5189 bp, Oryza sativa
gcttgactcgttcaatttacaacttacaaaaaaaattgcaaaaaaaagaaagaaaataattgtttctagtgcttggttcgaggcctattcaaattttgatagggttttaagaggaaaattttagaattattagaatttagcaggggttgcgttggtaatggcgtatttgctatgttgcctctttaaatttcgacaatgaaaaacttggtaatgttaaaaataacaataaattaatctactttcacatatgaacaacaaacatgattttacccaaaaaagaactagtacaattttagccactgtaaatgcttggcaaatgagcccaataagccaatcaacctggttattttttttgtcagtctggttgtgtggtgcagtgcagtggcaacacaaaataagagaggctagctagagacattttacatagacttgcctttgaagaagggaaagaagggtccacgataaccagagagcaacggtaggcgtgtagtacaaagtagtagcattagcacctaatctaatctcacctgcggtttaggtaacaagagcatcgatcgatcactggccgaaagaacacagaggagacttctcaaaagtaaagtgatacccacgttattttcttagaggagactaatcacagggaatcgaagaaactttagacccttttttttctttgaaatatggatacttttcctatccgtacaattttcatccaattggaaaaagtaaaaaaaaaactgcaaactgaattgtaaaaatgagttgaagagagtcataaattagggggggggggtagcagttacgaggaatgaaaaaaatttcagcattcagtgaaaggctcaaataaataattcgaagatatttctacctgttttgaatatttcttctttttttaaaaaaaaagagaggagagagaaagggagagactagctagagagagagagagagagagagagagagagtgaagaaggaagaagggtcaataaagaggcgttgagctccttcctttccccattctcactctcggccttccttccacggcagcgccacccactgcgccttcgccggcggcggaggaggagggaggtgcggccatgggtcacggtgtcagctgcgcccgcaccggcgacgagcacgacttcttccgggcggcgcagctcggcgacctcgacgccctggccgccctcctcgccgccgacccttccctcgctcgccgcgccaccctctacgaccgcctctccgtcctccacatcgccgccgccaatggccgcatcgaggtcgctcacctcactgcttcttcttcttcttcttccctcggtctccgggacttgcttgtctcaccctttctctcttgttttctttcttcttcttcttccaggtgctctccatgttcttggatcgcggggcgccgccggacgcggtgaatcggcacaagcaggtgcgagatccccaccaaaatctctcttcttttttgctactgtttttcgaattactagtatctgcttgaaaatatcatattttgattttgaatgaaaaagaaagatctcgtcttgtccttttgttttctcaccttgctttgctcttcttctgcttatgctgcagacgccgctgatgctcgcggccatgcacggcaagatcgactgcgtgctcaagctcctccaggccgacgcaaatgtgagagaaaagaactgcaaaatcagtatactgataatactgtagtaattctgtttgaaaaaatcagtaacagttacgatttcgcaccagatcttgatgttcgactcggtgcacgcgaggacctgcctccaccacgcggcgtactacggccacgtcgactgcctgcaggccatcctcgccgccgcgcagaccacgccggtggccgactcatggtgagatcatcctcatcctgtcgtgtggctttggtacagctatagaatagctctggatgtctctgtgagctcacttgctgctgtcgaagcttggcaggggtttcgcccggttcgtcaacgtcagggacgaccacggcgccactccgctgcatctcgcggccaggcaggggcggccggggtgcgtgcaggtgttgctggagaacggcgccattgtgtcggctttgacaggatcatatgggtaatgctgctgatcttggtggcatcccaaattaatgtttggtgatcagctgttcagctctgttggttccttgctaccagtgctgattcgtgtggtggtgttgtttgatgcagcttccctggaagcacgtcgcttcatttggctgctcgtagcgggaacttggattgcatcaggaagctgcttgcctggggagctgatcggctccaaagggattcggctgggtgagaactagatctttcccccttcagtttttgtcttggcgcatatagaagaaaacattgatgtgctatcaagcatagttgttagtgaagttcaggtgttgaatttaggtgcttagtagaatccctgcagttcttagacagtagacctcagtctagcaagtagtaacaggtgaactcgctgaccatttgctgaattcacatgagcttgctgttcttctcaaacttgacctgtccttttgctgaattgcccatgctctgccactgattttaattttaatggtttttgtttccccaggagaattccctattctgttgcgctgaaacggaaccatggagcatgtgcagctttgctgaaccctacatcagcagagcccatggtgtggccatccccacttaagttcatcagtgagcttgaaccagaagctaaggctctcctggaagcagctctgatggaagccaacagggagagggagaagaaaatcctgaatggcacaaagtactccctgccatccccttcgcccggtgatgacagtgccgatgacgatgcatgctcagaggtatttgagtgctgaacaatttcagtgttatctgtcagattgggatcccataaacacattgtgtaatttagctttctgtgcatttgcatgatgactgaatggctgtgttgatcatttgggcacaggtgagcgacacggagctttgctgcatctgcttcgaccaggcttgcaccattgaggtgcaagactgtggacatcaaatgtgtgcaccgtgcacgctggcactgtgctgtcacaacaaacccaatccgacgaccctgacaccgccctcaccggcctgcccattctgccggggcagcatctcacggctggtggtggcccaaacaaggtctgcttgtgatcctgacaagccgtcatccctgcagctcacccggaagcggtcgcgtcgatctcacaacctcagtgagggcagcagcagcttcaaagggctaccttcggccatgggctccttctcaaagcttggccgtggctcgagccgcatggcggacagtgacagcagcaacctggacaagcctgagcacgatctatgaaagcagaacaacgcacggacaatcgccgcatcatcctcaaaacatccgttggtatcagaaacccagatgaaaatccaatggctaatttggagcaactttgatccatggaaagttaaatagatagggactaaataagtagaaccctccactccccattgtctgtgtgcccaccctatttttcggcttgccgggttaagcttagcatatgcataggagctctgaaagaccagagagagagtgagtgagtgagtgagagcaattcatcatcaatcacacagtgagtgttggtgtggttaagggatgcatgcagcagagatgtgaaacggggttcatgttcgtcacctctaaagttagcctgccatggcatgtgagctctgcgccggcctgacccctcctcctctgtgtgatgaatcatgcccccatttttggcccttgtctcgtgttataatggtgcgagttcatgtcctggtgatgctgcagccatcagcagggtggtccattggatcgccatgaattcagcagctgcggtctctgcctatgtgatgacattgtatgtaccgtactccagtgtgtaccggttctttgaactgtggtggcgtgtcactgtctctgtcagtgccactgtccatcgtcgtccggctgttacagccggattgttactgctagtaattggcttccttcgttcgttcgtgatggcatcagcatcagattgtttcttttcttcaggctgataaaatgaagactgttgttgcctgtagctgtatggttgtccttgcgatctgtaccttctcttgtgctcctacctgcagtgatattgtgagatccaggagtagcataatttttctatcgacaaatcataccactacatttcacttggaaagatggacttagcatcataggtttaggtgagactgaggaccaactctgattaacactgaagtctgccgtgtggattgggtttagattgaaagaaattcatggagataacaagaatttttgtggcaaaagctttgttgttatgcagagtttaaggactaggagatgactatatgagacacaagccaagtgctactgtagtttgttttgaccaggacacagcacacaacttggaatttggaaaccttccaagtcatggctgcaattccacgtcaggcttggtgatcgacctagtagttcttttgcttcttgtgacgaactgacgataacacggacagatatttgtgaagctttggccattctatagtccatatgatcactcaagcaaaaaatatcttggtgccacacctcatcatgtgacagaaactaactaataatttcaaagtgcgattaattactctctgatggctcatcactcagccccaatggctgtttttacttgtgctcccattgggtcccaatagacgctgaattaggagacaatggttgtgtcgttttgttcctggagagcagtgacgtgcctataggcacactaccactacagtgatgaataatgtcccctctcttttttttttgttttcttttctgaaaacgagtgatgaacaatgtcatgttaacttcagtcaagtattgagcaaattttcctttggaaagaggataaaaaaacggtattaatggtgtttatggctggaccagaaatggagggaaagagagacaactgttgatgagcgacctaacgcggcatcaccgtcgactcgttttcttggtcttggccgctttcgttttcattagcttccttctcttttctcaggctgcctcgt

SEQ ID NO: 735 - DNA, 3248 bp, Oryza sativa
cgatttcaaacatagatgttttggactttataacttgtctccacacccaagtcgtagaatctttactgattgaatgctatcactcgtcatttccacaagcctaacctgtaggaacaattaattatgtttgacttaatttgtgatatactaaaaggaagcttttgtataaatccaccttataaaatgactaatttccacgtcccaattgctcccaaccatcctaaccatgcttcgtatggaccgtaataaaaaaaaaacagccttccaaagtgaagacactcgccaagaatctcaaggaaaataccagtaccttcttatagcacacaaaacaatactcaactctagccaactactcctccgttccaaaacaaatgtaatttcgcactattcttatctaatgtttgacatttcatcttatttaattttttttatgattagtatttttattgttattagatgataagtcataaatagtattttatgtgtgactaatatttttaaatttttttataaatttttttaaataagacagacggtcaaacgttggatacatataccctcggctatatttattttgggatggatatagtagtaacaataaagtaacagagtccaacgcaaaaatcaacttgatataaaagtggcatgatagctctaatttcacgaacacatgctattgttgtcaaacttgccaccaaacagcacggcagctccgactacacagtgatagcatcatcttggccaaagatatcatcaaaatgaacaaacatcaccgatttctcacagtcgacattagaatcattcttacctgtaaaattctaaacaaaacattgcttgtaaaagtgcaagaaggcttgcaggccagagatagagacaagacatccccgttcaccagcagcacaaaagaacgtagcaacgatcagtggcagcgttgcaattacggaccggtgtggcggtgttgttgcccatcccatcaatttagcagctgcgatgtcaccaccacaactattcattatagccacccagctaacaccatctcgtgcgctcgtggcccttggattcaactacccccgcgccttgatatttgcaactgcaaatttgtctatatacaaaatttgtctccacgttttcttggatagttagttgctcacccgatcctgtatccatggcggccgtgtcggaggtggaggtcgacggcgtcgtgttcccgccggtggcccgcccgccgggctccggccacgcccacttcctcgccggcgcaggtttgtttgtgtttgcgttgtgtgttccgtgtcagtggagaagtggaaatgccgtgcaagcgaacttgcttgctggtttgatcgatccgtcgtgcaggtgtgaggggagtggagatcgccggcaacttcatcaagttcacggccatcggcgtgtacctggaggagggcgcggccgtgccggcgctggccaagaagtgggccggcaagtccgccgacgagctcgccgccgacgccgccttcttccgcgacgtcgtcaccggtaactcatctcgctaaatttgttgctcgtgtcgacgggcggcgcgacatgacatgggcgtcgtctcgcgttgcaggcgatttcgagaagttcacgagggtgacgatgatcctgccgctcaccggcgagcagtactcggacaaggtgacggagaactgcgtcgcggcgtggaaggccgccggcgtgtacacggacgccgagggcgcggccgcggacaagttcaaggaggccttcaagccccacagcttccctccgggcgcgtccatcctcttcacccactccccgcccggcgtcctcaccgtgagcaccaatccgttgttgccgattactccgatgcgtgatttgcttcgtgatttggactccgtttgattcgatttgcaggtcgcgttctccaaggactcgtcggtgccagagggcgccgtggcggcggcggcgatcgagaacagggcgctctgcgaggcggtgctggattccatcatcggcgagcacggggtctcgccggcggcgaagcggagcatagcggcccgcgtctcgcagctcctgaaggcggaatccaccggcgacgtggcggcggcggagcccgcgccggtgtccgcgtgaaaatcgagctgcgaattaaccgcgcatctaagagctcctcctacacttcttgtacacttctactgccctcgtgtttgacaatgaaataaaaggaaaggagaaatcgcggctgttcttccgttccatctctgaattgcctgtgcacggctcgccacggtagaggtgaaaatggttacgaaaattctcgatcgacgccatttctgtataatgggtaccgttttcgatcttattatttttagctatttataatattttatacattatagtattaattaatataaacattaaatagtttaaataataaatatagttaattatcctgatcgaacgtcgttttcaaaagatgctaccaattcagatcgttttcacttatacgaccggtgagtacgggatattttctgcgattaggtagacgcgaatggctgatgtgagtggctacgcaattatgcgaagcgagcgaatgcgagacacggctttccgctaatggggcccggcccaattggcttaagtagatagggtgggccagtcaagggaggatctttggttgggccggcattaacaacggtgctgaaaccgtgagaaataagtccatcttccaccctcaactaatgctctttgtagggtttcataatgtctataaaatgaagacacatgactatggcagatgtgaacgactatgcagttacacgaagcaagcgaaagggggcagctaatgggcgggtgataagctactctctcacttcctcctcccctcttctcttcctactacactatatattttttaaaaaataaaaaaataaaattgtaaaaattcatgtatagaaatactatgtataaaaaatatttgaattcaaattcaaatttgaaactgtatgtaaacttttgacctataaactttgggtctataaactttaggtgtataaactttacatgcatagaaatactatatataaaaaaatatttgaattcaaattcaaatttgaatttgaaatataattcaaattcaaatttgaaatcaggtatataaacttttgacttataaactttgggtctacaaactttaggtgtataaactttagatgtatagaaatactatatatataaaaaatatttgaattcaaatttaa

SEQ ID NO: 736 - DNA, 6937 bp, Oryza sativa
ttatggttgaagtatagcatctgtcgcctaatctctgcacctcatcactagagttcgattatgccgtatatatgggatcgagatcctctaacttttaagtcacatgactttgagtcactgacatgtgagccctctttgttatggacccacatgtcagtgatttgtcaaaggattttaatccgtatatataaactagtttggttactaccctcacacaaacattgcatggcctggttttttccttgtgtggttgcttccgcgagaactccctttgcctggatctgtttgttcctcgcaccatgtgaaaagatcggacggaacggcagccagccagccggcaagccgccgcaacgagcgtctgcacttggcgaatttcgccgtataaaccaacagcgcgaggcaaggcgaagacgagagagtgaaacgaatgagttgttcaaattgtagtcaaaataaaacttaccaaattttgacaatatcaaaattttaataagttggcaatatttattaaaattttggtatgattttcttatgtatctattgaagtttagtgaaaaactaaacacatactttttccgtcccaaaatataagaatctattactggatccggataagacattttcaagtactacaaatctagaaagccaaatataagaatttagaaccggatgaaatattttttaatactatgaatttggacatactatctgtctaaattcttatattttagaacgaagagattacatatttttgataactctataatttaaaatgacatcaaccccgtcacgacaaagcggtgtgcgagtgagacctccgcgaggggcagaacagtcaatcggctcgggccgccacttggcgaaaggaccgcgcacgtggcgcccgccctggatcccccttatctcggacgcaaattacggtcctgcccctctctctcgagcaaaaagcgcaaaaagggcaccccgggtggggcccaccgccccctcctcctcatccacctcctctcccctccccccactcgctgctcgtcttctcgttctctcgctcgcgcatcgtctcttgtgcttctccacctgttgttccattttctcctcgcttatctcttcctcgctcgctctccctttcgcgcaccagaaaagtcgttttttaattttcgagtttccgtggaagattctcgatacctgtccctcgtcgtcgtcctcctccgccggccgccgccgacgaccgcagcaggggtggatccggggcggcgccgattcggtgagtccggtctcgcgagctcgagctgtttgtttgtttgtttgtttggtggggattggattgggttggatttgcgttgtgtaggctagccgcatcagcgccgcttgtttggtggatttcgtgagctgctgctggattagggggctgggattgggattgggaggggggatggatcatggatgtcggtggattgggggggattgggtttgagtgttcgatttcgagtccgcttgatcgtttctgtggtgttccagggtgtttggtgttggggagtctgaactgattttttggttttctttctttttgcggacacttcacgctttctctcgtgttgcgtggagcgtacgtgagtggtttttggtccggctttagctttgagctggactttagctgctcagaatttgattatttttctttctctaattggagtacatacaagtacgatggcttagcatgtttcagtatccagttcagttttcaactagaaaatattaacaatttcatcccctctgcccttttgtctactgacataatagtcgtgtagcggcaactgcggttagatgcagaaaggaagcccttttgtattcttaaatttggataatcttaaaaaacaaaataacatttctcttgcttatttgagtggctcagaaagtttgttgcttttatccacacacggcatgctttatatgatcagagaagtggggttagtgctatttaaaacttaggattagtcccgataaaattgtttgtattgtggagatgcatgcttgttgatttacatgattagtgctcagaaaaggtgcccttttgatatgcaaaataggacataccagcgtcaaaaataaagggacataataaaatgagcaaccaggatcattgttggatgcacagctggtgaagtcctatttgtattgccgcttctagctcttgcccatgcatgctaataagccatcccatgctggtacgaaaagtgacttttattaactcagaaatgctatcaactgcagctagcatttgtttgctgcatagctccatgttgctaatttcatgtttttccattgttatcagatgcattgtactgctctctgctagacttgtctagtgaattggtgttattgacccttattttttaaacatggatacttttttcccccttatatgctttacagagaacatgcgcttacaggttacagactgacagtacataggatagaagataaaaccgtaacatttaccaagaaaaacttcctgcaagtagttttgtgcccttctatttcagagacttttgagttctttatgcccttgctagcaaatcttgggtgggataataaaactcaaaactcttcacaaattgttatacgctacctatattttaaattgttactaagtcaatgaatatattgattgctcttgttgtgatacatttgaaatgtttctgttggttgcagagcaattcaagtggttcatttcatggcctgtatcaatatacttatatatctccaacacttaccaaggaatggaaacaaactcatcatgtaacatgggctgcaaaatctgtcccttcttttctaatttgaagtgtgcacatatttgctatattttccattaaaaaaatatactactctctttccataatgttcaattataagtttgttgttttgttgttactgatttttgtttttggctttttgcacaccagtatcctggtaggatcccactgaattcaactgttgaacaaaaagccaggaaggtggctgttcttgtggcactcagtgctagtggaagtgctccagtactgtacaggaccatggatgctctttgtgatttctgcagggagcaaaggtcaatggtctattgccgatcagatgcagcatccttgtgcttgtcgtgtgatcgtaatgtgcattcagccaatgccctttcccgacgccatacaagaacccttctttgtgatcgttgtgttggacagcctgcagcagtccgttgtcttgaagagaacacctcactttgccaaaactgtgactggaatggacatggggcagcatcctcagctgctgggcataaaaggcagaccataaactgttactcggggtgcccatcgtcggcagagctctcgagaatctggtcctttagtatggatatcccaactgtagctgcggagccaaactgtgaggaaggaataaacatgatgagcattaatgacaatgacgtcaataaccattgtggtgctccagaagatggccgcttgttggatatagctagcacagcactcatgagtgatttacctacaggagacaagttcaaacctttaataggttcttcttcaggagatgggatgaatcttctgccacttaattcagatcagccagctgagccagtttcaacgacgcctaaggtgcatgcttctcattcccctccaaaacctattcaagtattctgctaagtttctgcataggtcataacatattgcatggacatattattacaccaaatgttcacactgcgtggttgcggtttcgaccatgtactttgttttggtattcttctagaagtgaacgttcgaagggaaaactttctgtagtttgaccaatggtacaatgaccatcttttggtcattatttattactgtttgctactttcttaagagttccacactgtcaaagctttcctggtgtttttctcctgccgagcaagttactcttatcttctaataattttaccattgaatgtgaattcacctagatcttataattccctaatgatgatggttgaacaattgctgcagttggaatttgtgtatttccaatatcattattcatgaaaatgtcatctgcgatgcctgtcattatggtgtcactgcgtgcttatcgaaacttggttgcataattcaggcaccctgtgtcacagacaaagatatgttcaatgatgggagcgtatatggagacttctgtgtggatgatgctgacctaacatttgagaattatgaagaattattcggtacctctcacgttcaaacagaacaactctttgatgatgctggaattgacagttattttgaaatgaaggatgtgccagcagatgaatctaatgaggtccgtacctttctgcatatagtctttttatctgctgtgtttgttgtaggaaaagagctctgttttgctatttctgaccttcccgccataatcagggttaatctcgttttcctccatttgtgcttatatcgagttgaccctaccattttactgagaatcattaaatgattgattgggttaattaggagtggaatgtctgcatatctcatcgtccattttatggctattaattattttactaaaattttggtatgactgttatactttcagcagcccaaacctgtgcagccagaatgtagcaatgtcgcatctgttgattctgggatgtcaaacccagctgcaagggctgattccagccattgtattcctggtaggcaggctatatccaacatatccctttccttctctggtttgactggtgaaagcagtgctggatattttcaagattgtggggtatcgtcaatgatccttatgggtgagccaccctggcatcctcctggtcctgaaagttcatctgctggaggcagcagagataatgctcttacacggtacaaggagaagaagaagagaagaaagtaagtgcatcttactgtgctttttcagttttttgaaagtaagttcatactagtacttgatatgccatggttaaatgcattacagctaagaatgtggctgcagtatcattcaattttcagatttggaattctatattaaaaagcttactgtgccaaatcgatattttcgtatacacgtgatcattttagacatgtggatgcttgctcctagtgtgaatgctactttatgtttttcttaaaagaagttattatatggcctttcttcacatattttcttcttaacagatttgacaagaagataaggtatgcttctcgtaaggctagggcagatgtgagaaaaagggtcaaaggacggtttgtaaaggctggcgaagcatatgactacgatccgctgagccaaacaagaagctactaaagcctttcactcgattggtttcgtccagtgttcaagtagcaattttcagcagctgatttgatgttggttgcacggcaagcatgatcactggagaacacaagcaattgcggcagaccttgcaattgaaaacggggaaaggaaaccaaacgctgtgatcaaatcaaattaatgaaataaaaaaggaaaaaataggatgcaaacatgcgagaagctcatggatggtaatgctccattttctcctgtacagttcatgcatcttcagttgcttctggttgagatgtctgaatcactctctaccatctgtgcattaatcaaatacaaatacatgggcctaccgcacgacgacgaacgcacctgcttctgttgtgatgttttgtgttgcggctgtcaggctggatctctaggtaacatgattaattatactactgatggaatttgcaccgctgtaatattatttacgaatcacaatctgccgtgggattgttcttctgtcgtgtatgtatgtgtatatagatggatggctgttaagaaaatattgtgacgattataaagtttacctttgtaaatgatagtaaaatgctgcattgatctgtagggtgagcatagagctttattcaaattgagacgtgatcaaacatgcgtgctaatttggtaacctaaattgaaatcaaatatgcatgcaacctaagtagatcactaactcgatctagcgcgaggctgctgtctcctctgtcaaactgacatgaacggtaaatctagcgcgaggtcgccgtccccgggatccgccgtgtctgaggccagcgtgcaagaatccaagctcgacgcgagagcgtcggcgagagggtgctgcggcggcggcggcgactctgactccgcgacgccgccctccatggccgccgagtcagcggccggcggcgggcaagtggcgcccgtctcggcggcggggaccaagccgctcaggcggtggtgcttgatccggcaaccgaccgagatgcgcgaggcgcggccatcgacgaccgagcgttggacgtggcggtggaggagcatggtcccttcggcgccgcgggcggcgaaggagtcgtggtcgacggcggcgaagacggtgattcggtagacgcgccggtggcgccgcacgtcgcgggagcgccccagcggcgtgcacccttcggcggcacggcgctgcctgccggagtcgacgtaccggaggcgcgcgttctccttgggcgtacggtgcctgacggcggggcaggcagcaaacctgcccctagccgccgcacacaacggtgtggccggcggcggcggcggtgtcgtcgtcttccccgtcacgatctggatcctcttttcacaaaacggtgacccgtcgtagccgctacttccttcgatcgggtgccatcgtcccagcagcatgtcaaactccttgggatcgtcgatggctgtgatatccatcgatcctgattccatgggatcgtcgatggcgagtagcggcgacgaggaggacgggagataagattaattctgatcgatcgggatcgattcactagatgcattggatgatcttatatggcaacgcgtcctcgttggcataaagttagaa

SEQ ID NO: 737 - DNA, 5666 bp, Oryza sativa
gtgcctacagaacacatatgttgagagaagtttagggatgaaattagctcgagtatattgggcaatgcttaagctaattaactagccggccaaaacaacagaccggcactaactgagcatatcacattaattagcaactctcttttagcagtctgacaaaaatgcaactagctagctagcactgcagatatatattttttacttgctctaatcctctaaatatgagacaagctggtataactaatgagtgacatctagctagcactctagataacattactcattgtgaatatgacaaggaaacataaaccaaagttgatgctgcagtcagtcatgcatggagtacatattgcagtgtcctgccagttgtcaccacatgttttttttacatgtatatatccaatccagctaagtgatgatcaaggcctaatttcccataagcacagtgaaaatttgggaaatataatttttttctcagagaagatgtcccctctcgtttcttacatattgcttatagttattatttattcttaaaaaaatgacaagatagattaatatgaaatatatattactctacaaacatgcaacatcaaatcctccttttacaaattgtaacgaaagaaaaaaaaacactactccctccgtcctattttaagtataattgtggattttttatccaatgtttgatcctccgtcttatctgaaattttttataattaatatttttattgttattagatgataaaacatgaataatactttatgcgtgatttatttttttataagtttttcaagtaagacggacagtcaaacggtctacataaaaaccgtacaactacacttaaaataagatggatggagtaacaagtatgcacacaatcacagtcatatttattactaagcagcagtaagctaataagtatgatggaactgatcaatgcctgatccatcgatatgcatgcgtgatgtgctgcaagtgagagagaattaaaaggcgagatgaaactaaaggggagggagagagagagagaagaaaaaaagaaagaaagaagaagagggcacggctgcatggcgtagctagctttcttcctggcccagatcgagcgagcgcgatatgattgcatcatcgatcgagctcagctcagctcatctcacctcgcctcgccttcttattctggctcatctgcaagctgcagctgcagcaactgcaacctgcagaaggcgaggcgccctgacgccttttcccgcgatctgatcttgcctcccacccttctcctcccacttcttctcatccacccactgtagcctcgagaccacacgtagagttttagctagccatgttgctgtctgatctctcgtctgatcaggaggccactgggtccaactcccatggaggaggaggaggagatcgtatggtggtgggtagccatggcgccgcccatgtcgtgctcagcaatttgtttctgccaccggcggcggcggcggcggcgacgatgctgctgcctgctgctccggtgatggtgcggccggcggcgatggcggcggcgcaggagccgagagccaagaagaagaggagcctccccggcaacccaggtgagcgagaaactgcctagctcttcttcttcttcttcttgcttgatcgatctcatctcaattctgctgtctcgccatggtgttggatcgatcagacccggaggcggaggtgatcgcgctgtcgccgcgggcgctggtggcgacgaaccgcttcgtctgcgaggtctgcaacaaggggttccagcgcgaccagaacctgcagctccaccgccgcggccacaacctcccctggaagctccgccaccgcgccgccgctgtctccgccgtgacgacagcggcgccggcgccgaggaagagggtgtacgtgtgcccggagccgacgtgcgtgcaccacgacccggctcgggcgctgggcgacctgaccgggatcaagaagcacttctcgcggaagcacggggagaagcggtggcggtgcgagcggtgcgggaagaggtacgccgtgcactccgactggaaggcgcacgtcaagaactgcggcacccgcgagtaccgctgcgactgcggcatcctcttctccaggtccggccacccccacgctcgccgttaaacacacacctttgattactatttattactactccctccatgctctaatacaacggattttgacattttacttgcactatttaactattcgtcttatttaaatttttttggaattattatttattttatttgtgacttactttattattcaaaatctttaaacacaacttctcgttttttatatttgcacaaattttttttaataagacgagtggtcaaaactacaaataaaatatcaaaatctcttatattagaggagagcgagtagctcttaattaaacttctttgcatatgctattgcattaaaaaagaacatctctgaaaaaaaaaacatggatggacactgatcaactaccaactgttaattcatcactacttcgagaggttttgagtattttggcagtataataccttgatatatatcttccaatttcgaagctagtgttcttcttcctgttcttgctcttgtttcctagctagcccaggctttctgaacttttagtccgaagttaagcatatactctcactggatctggtgttttatgtgaatttcatctgaaaattctgcatttgcaaacgggctttttgaaggtttcaatatgtgcttgttattaatctctaatgcatacatggtgcttatcatgtacgtcacacacacacacacacacacacacacacacacacacatatatatataatcatactcgaaagttttatatttcaaatatgtttttgaaaacctgcaaatcctgcatgcagctagctagctagtccggggcctttttcaatggttgggcatgcatgtggccatgagatctccatcagaatttcaaagccatcttcatcatcatatctgcatttgcaggaggcattgatggaaacacttcatttatagataatttgctgctgcagtaggatcgctttcttgctcccttttcttgccacagttcctgcattagcaattgaaatttaaggaggcagtttcaaggagcagatatagatatatattggcttatagttagctatagctagcagctgggggaccccaagatacacaataattatgtacactaagtttacacatgtaattaattatctatgcaacactaccaaaaatattgatctcaagaagttaattaattaaacagacactaaaaatctctaacatttaccctgcttgtagctctaactagcatgtaaatccatgaacctgaacatccaatgatcacacacgcgcacaaaccttggaaaagaaactaagctaatcatacggcaaggagacctttcttcaccaaagttaaatgcaactttacatgcatgcatgcgttcatcactgatcatgtgcacatcatcactactgttaccctacaaaatttgggaaatcaaacataaataatcactaaaaaactctttcatctgatcaatccacagtcgtccttaattaaattaacagttgacaaaaatacaataattccaattaattgttcatgcctgcaggaaggacagcctgctgacacacagggccttctgcgatgccctagctgaagagagtgcaaggcttcttgctgctgcaaacaacagcagcagcatcactactaccacctgcaacaacagcaacatcagcagcaacaacaacaacaacaacattaacagcattagcaatagcaataatcttctgatcaccagcagcagcagctcaccaccactgttcctgccattctccaccactcctgctgaaaaccctaaccctaatcagctcctgttcctgcaacaacaccaagcagctcaccaccagctgcttcttcctcagttccagcagccaccctcctcgccgccggcctacttcgatcacctcgcattcggcggcggcggcggcgtcatcaccggcagcagctgcaacgacgacaatagctcgatcgccggcgatgtcatggtggctgcaggtggtgacagtgtcagcttcgggcttacctcggaaggctccgtgaccatgcacgccggcgacgtcggacggcgccggctcactagggacttcctcggcgtcgatcacgacgccggcgaggtcgacgagctcgagcttgatgagctgccggctgatctgtccaccaccgccgccgcctgccagggttgcaacttcgccgccgccaccaccgccgcctgctgcgccaccgacttcaccaccggcagcaggcagtacctcggccggctgccgccggtgaacgagacgtggagccacaacttctaagctagccatgaagatcaagccataatgcaaattaccaaactcttaaaaagcagaaaatcgaaactagtgccaatgccacatcgatcgcatgtgtcatcgatcctccatgttgttgatttcttgatcttgatttttaaaatttcgtcttaatttcacttaggtgttattctaacttttgcgactctggatgccaagaagcttcatccatgcaatggatgaaccgatcaaatttatgttaattgttttttgtgcatttgttgagatggtgatggcacattgacacctgcagagatcagctgtttcttgtcacagtgttatttttttgtgtaaactagatgtagtactccagtaggcagcaactcaatgaccagtgttttaattctcaactactactctatgcatgaaaacactttcatgcatgcactgcatgcaaaagttatactactgattgtttagcaaatttacatgcatggatttgcatattgcatgcatgaatgatgagcagtgcacatgtgcatatgatgcatgaatgcatgtatatatggatagtacataggacttagagctctcggcagggaccatccatggcgagagatatacatgtgcaatccctaggtagaggaattgatcagctagcacatagtttgagaattaaagatggagaagagaagaatgaaaaggacttgtgaaaaatgtgtgcaaacttctttattgccgtgcgttgacacgcatcatgctcatgtgcccccacacccatctcctagctcctctaccctttttgactcctaatcattaattagtaagttcatcattagtataaaaatgtcaagtcgccatcagcgtacctatgaacatacatatggttagttacattggttaattaataaaaatatcaaataaaccaaaataaagctaggatttgatcgagagaaattttatgatacttgagaagaggtaccgatcgagaggcatcatatttttctagtaatccctcgatttcttattgttctagctttgtactaattaagttaaacatttatatatttgaccatgattttttatattttggtgtagtttaacaacatatgaattatatattgtgaaagtattcctcatggtgaatctaataacataaatcttatggtgttgaactatatgaaattgtagaaaatacttcatccgtttcatattataagactttttagcattgtccacattcatatatatgttaatgaattagacatatatatgtgcctaaatttattaacatctatatgaatag

SEQ ID NO: 738 - DNA, 5729 bp, Oryza sativa
ttatggtagaatataaatggaggagtaaaagaaacgctactagttgtatttgggcctttgggggcgtatggagcgttgattttggtccagcccgggtaagaaactataaagttgacattgttcatcattgacaattgtcatggaaagtggtagtgttcttcgatgcttttcccactgaaacatttggggtgtcttgctgggctgcaaaacccattaaaacatgagtttagtgaaatataaaaatagagcatagaaatcgacacgtggtattgcattatagcgaaaaccttccgtcactatattatttatattttaattatagttatatttctcaatacgtcataggtttttcccgcgcatactgcatgaatccacccgcacacgtaatggaacacataaccaactcgaattgtcttgtatattaacctatgttccgttatctttttttcgccatcctgcatggcaataatatgttaatacttgtttactcaatacatcaccgattaagaacaatctagatgtacgactagctataatctctttgactctataagttatctctgtcaccacctctattatctccttttactcacttaagctatataccagcctaactctaagatttacatgtaacatgaaaaagaagaatctcaagggctatgtaggctctatttggggagcttctagctgctacaacttctcccagaatcagaagctcccccaaatagcccagcttttggtccagattctgataagctgtagttatagaatccagaaaatgaactagaagccaaaagctagcttttccagattctcagaagttggctatcaactagctgcttgtaagaatcttaagctcctcaaatagacccataattttactcgtagatgtgtatggtggaaacattggagtattggaggtttggtggagcgagcaaacacaagggcccacaggatgaggatgggttgtcttgtgtccagcccaaccccgtttcagtttccattcccgttccgttataataagaggagagagagagagattttgggtttgtctccggctccgctcgccgcctccaaatcccgctcctccgctgctgctcctctctgccgcggcgaggcgagagatccgaatccaccgccacccgcgcccaccccgcccgcacaaaccctagtttttccggggttttgcttcccctccgcagctccgctccgctccgtccgtcgtctcctcccggcggctcggcttgctgtccatgctgtagccgccccccgcaggtggctgatgggctcccagaaccgccccccaccaccgcgcaagaggcagccgccgccgccggaggaccacctcgtcacctacaagcgccgccgctccaaagaaacacaggtaaccaaccaaccaactccctgcctcttcttcttcttctttctccagatttcctttcgatttctacaagattcgtactctcgcttcttgcctcctcttacaatctctcattacatctacttgttgtgctttcttttcttgcagcctttgccactcatggccaacggcgccaattctaagaaagacgccaaggcccaacattggattagctggagggacactctccacggcttcctccaatcccctgctattagccagggtggaggaattcagacctgcatccgtcatgctctccaacacaatccttgcttgctcaccaatggtgttgttgttcacactgaattcaaagtaacacacaccacctttgtttgcatctaccctatatatatttatgcaatgataattttcctaacacatgacttctttctcattaccagggtaacccagctcattcccaaggagaggaagcaaaagtgcagcaccctaatggtgctgctggaggcaaggtggtttctgcagatgctgctatacaagatgcggctgccgcagcttcttccgaagctaacaaggcaatgtgtaataatgccctcttcgacattttggtctcccagaaatttgccttgttgtgccatttgctacttgggaccttccatgtcaataaacctggtgatgtcatcgacttggaaaaaatcgacgccaagatgagaaatggagactatgcccacaaccctgcactatttgacgatgatatccagcaggtaattgtttctctattgctcccatgaaagtaatttagctactgttgttggagggaaataatactagctagtgtttattcttatcttttatctaataaagatgatgcatattacctgtacttataagcgccctctgtatgctaaagcttaatgtgttctccatctattattgttcacaactccgtaaatcataagagcaaaatgttctacgtacggccagttgatagaatgatgctgatgctcaactgcttatctgagcttcttttgcgtttgctagttaagatcttcccaaattgtttgaaccatccaagcaacagactcctagggagtttatcacaactgaccttctagaactctggttgttagggttggaacgctagtcaacttaaatggtatactagccctgtttctacactatcatgtcttcgcaactttatatgctctatttctatctgtctgcttcatctgctgtccgcaacatgccaactcccttgcgcttcatggttgatgaagtggaccatggataatgtggttgagctggggtatgacacacacaaaattctggaacatctcatgcatgctgcatgtgtaaccactcaatgctgaggtttctgtctaagtcaactagggttttatcacttgttttcttaaatgggcacaacacaaaaaagaaaacttttataatatttagtgctagcacatctcaaagaccgaacaattactcttctatattgatttccttatcagttatcattgatatacttttttcatctgtgagtttttttgtttacattatattgttcatgctctaaacatagaagttgtgtagtaacatctaggaaaaattatacgatactgttgcctgctgagccttcctcttaatacaactctctatttgtttattttgtagatgtgggagaagtttgagcaagttggccaagagatgacaggtctagcgagcaacctttcaaccatttcacgagtttcataccaaaagcaggtaatctgttgctttatctttcaattaatgtctctagcgtcgagatggttatattttgacaatttgagttaagataaatctattactgcacacttggcaaccatgctgcaatttgcaggatgctttagtatattgaaatctttccttttatgctgggcattactaatggataaattattttataggcttctggattttctgaagctgaggtggctgagcacagaatagaggtaagttgtctgtttgaggatgtttgctaatcattgttccacatgcacacttaattaataatggttttactaattgcattcttcattaggaaataagtttgccgggtgctgtccacgttgtcacaaaggagtcgactaccaccgtgcagttggccccatgtgattctagtcattctacaataccgaaacgaactgtgccacctggacgtgatctgtgcccttgcgatggttgtggcaccaaggtagatgttgaagaaggcctaatctgtgatgaatgtgacaccatgtaccactttgcatgtgtcaagctactcaatcctgatattaagcaagtcccagcaatctggcattgttcaacctgcagcttcaagaaaaaagaattggctgcagataccacgaataatgttgcccatgactgcttgcatggtggtaactgtgttttgtgtgaccagctcgagctggtgaagacagaagaagaagatcccaagcttcccataaaaattgaattagctgaagaaagagaggggagctccgtctcaagcatgggggaagacaatgaaccagacctgtcaacaactgccctgtcaaacttgtgcaaacactgtggcacatgcgaagacgatgacaagagattcatggtatgcggacatccttactgcgtttacaagttctatcatatccgatgcctgaaaacaagccagcttgcaattgagcaacaaaagaagcttggttgctggtactgcccctcttgcctctgcagagggtgcttccaagacaaggatgatgaccagatagtcatgtgtgatggctgtgatgaaggttatcacatatattgcatgagaccagcacgcaacactatccccaaaggtaagtggtactgtacattttgcaagatccgcagggcagcggaaggaatgcataagtatgaggattctgtgctgaaaatacatgggaatagtaagcatgcttgtaatgtgaatcagtcgaaggattctgaaggtgatggtactgaaaagtgatcatcacaatagctttgtggattagcttctgagctcgcttggacaagctcaggaaaagagattctttggccccttaggagggctatacaccgactttgatactgaatcagttgtgtagtttatttaattaactgccgttgacatctacaggaagaactcttacctggtgaagatggtgtatgtagtcttttagctgggcggaatgatgtgttgtttacttgttcaccttccttctttaccccctttcagtgaccattgtgaatgttgtcctgtacttgccctgtgatggtattcttaaacgtttttttgggggaaatatgattttgtttttttaatctcctttttattgcttgattcgtcattgtttatagcctgtgatcgatgattgtgaaggtttatagtctgtatgttgtgtatgtaatggtttggttgatcctgaagctttttggaggtcttatttcagtcgaggacaagcatgagagtcaaggaagaaagtggatcttcattttgtcagacaattgtgacagtcatggagcatgtaagtagtactagtatatagtttgagtgtatgactaaccctgaatattcattcctatagtaaatagtactcctatatcatattagagattctgtggttggattaataagtagtgtagctatatctccagatgatgaatttatatgtgtccttgatatgaattaatgatatttgtggtgagtgttgacctctatattaacaaatgcatgaacatgagaggatttgcacggcaggatacggaggcctgcctgcctaactgtagaggatttgcattatgtactgcttactccgtcccaaaataagtgcagccatggtttttcgcgtccaactttgatcactcgtcttatttgaaaattttttgaaaaaaattaaaaacataattcacgagtaaagtagtattcatgttttattatcttataacaacaaaattactaattataaaaaaaatttaaataagacggacgatcaaagttgggtgctgaaacttatggctgcacttattttgggagtgaggtactagccgctactgtcaggagtaggcatgtggttggcttctggaaccgtacgtgttgcgtttttcactcagaacaatagtgtattttttttatttagataaagctgaacaatagagtagtatgcttttattttgctgaaaatcaattggactcgtttgaccgtttgatttatgactccatattttactgaaatggaagcatggattcctaaaacagttggctggtgcgtcgatttatattaattaagaagtaagtcatggcagaaaaattctcaaactagttatt

SEQ ID NO: 739 - DNA, 10706 bp, Oryza sativa
tgatcaaatgttagacttagaaacatacaactacgcttcaaatggaacaaatgaaacggagtacgtattgtgcttgtcgcacgcgcgttaaactgaaaacgaagggacagccagcgccggaaagaagagttctggctggcctcgctccctcgaaaccacacgtgaaacccaggcagaatatgggcatcagagcatccgcaatgataaagtaacgtgccatctacaaaacatatacatctcagcaatagactagattaatagtaaatcacttcaatggtatgtctacatgggtatctatagctctctaatccattgtctcgtttttctctatagactatcttcaggttagtagatagctttgctttctctcttcatttaatctcttctaaataggaaaatatgctgacatggatctcttatagagagcctatagataaccattgtggatgccctcaagcatctcatcttgtgtagtgctctgtgtttccaagccaaagccgcttgggtgggtcaaaaggcgcatatatgaatacgagggagagggaacagtgtgggctcgcgtttcgttgcggcccagtagtacgcaaacacaagcgcaaaagcgccgccccgcagcgtagcgttggagcgtgcgtgcgtctttatgaagcgcacctaaccaaccagccaacgccgtcccagtccacctctccaaccgcaccaacacaacacaacacaagacaacacaagtgcaggggccaaaccgccaaattaccccccccccctccccatcaagtactacgagtacaggagcagccactgactaacctgacctgaccgccgcatgtgttgtcacctccccttgcgtgtgcgacctgcacctcctgcagaggagaggcaggcgtggctgccttcctttttccccaaaaccccctcgcaaaacccggaattactactactagtattcatttattgtattttatgtgattcccactagactagtagtagtattccactctctctctctcttctggtctcctcctcctctcccccgtcgctctctctcttgttcccctctcacacgcttgacgcggcccataggaagggggggaggaggaggaggaggaggtggcgaccgaccgccggattggaccgcctccgcgacgaccgccgctgaacccatcgccgatccatggagggagcagccgccgccgccggcggcggggagatgctatccccaggtgaggcggactggcctcccgagctgcggctcccaccgccgcccccgccctccgccgcatcggagggggagccgccgcccgcgcgggccgcggtggggatggatgactcgcagttcctcggatcgatcatcggcttgcccgcccagccgccgcaggccacggccgaggcgctcgcggtggtcggggtcaagaggaggagagggaggccgccgaagaagagggacggggcggcggcggcgacggcggttgttcccgcggcgaggcctgcgaggaggagggaggacgaggaggaggtcgtctgcttcatctgcttcgacgggggcaacctcgtcgtgtgcgatcggaggtgggtgggtgggttgggtgggtggattgctgcttgcgtttttttggatacctcggaaaaattcaactgagacgcgcgcctgtgtttttgcctccatgtaggggatgccctaaggtctaccatccggcctgcatcaagcgcgatgaggcattcttccaatctcgcagcaagtggaattgcggtgagctcatcctgctcgccattgttttgctctcctgctgctcactgctaactagcaagctgagcataaatgtgctaacatatttattggctcgttgttaccaataatagccaaaggcaccagatggaaaaatgaaggtggataataatagataactcgcacgcgtgtttgccgtgtagcttgggggagatgattcgccgcccaatcagtgttagaatcgattagagctgtcagatgcgcgccttgagaactgctctagctagctttgcatgctacactgctgttgctgtcttattgtgggatgctagaagaaacactaccttttcatgattgaatgaacaaggttcttcctcatccgagaaatcatggactgatatttcacataaatccaaatccgagagcaaaaggggaaaaatgatcttattattatttccaaacttttgctcatgatggttcttttaatggcttccatagttttgcagtaaagttttggtagtatctacaatttcgcatagggaaaattatagactccgcaattgacgaaaacatactaaaattgcacttctgacattttgcgccaggttggcacatatgcagcagctgtgaaaaggcagtgcactacatgtgctatacgtgtacatactccctttgcaaagtatgcatcaagcaaggtaaatttttcagtgtcagggggaccaagggcttctgcgatacctgttattcaactatactgttgatagaatccaaagatgaaggtgatacaaaggtatgcctattaccaaccacaaaaatattctgctttttttttctcaaaacatctgtttttggtcattccttcttcggaagaaattgtatgcggcatgtatattgcgcggcctcctttaatcgtaacccccctcctcctcccctccccttaaaaaaagaggaaataattacacacacaaaataacaacagcaacatgttagcacactacatgatttgtgcggttgcactatttgaaagtgattttgatatcaggtcctgttcaagttgcatctttgctcaagctctgctatatgtttccttcgatttcatgttcttgcatctcagctttttcacagtttatagctttgcgcttcaaattctaaaagtttcacgccttttcatgtgtgtgttgagttcattgcagattgttgttgattttgatgatcaaaatagttgggaatacctgttcaagctatattgggtggatctgaaagggaagctttcattaacattggaagaactaactagcgccaaggctcgatggaatgcacctactacttacactaggaaagaaaaggatgagtcatctgatgacctttatgatgctaataatgacgatgatgctggttctgactgctcctcaggaaagcgaaagagaaattcttcgagaaaaaagggtcgaaaacgtcggaaaccaaattctgattgtagcattgccacaaaaaaggttgagactgttactagagatgatggaaccctgcccaacaaggtaccaactgaagaggcgtccttgccggtagacaccaaatgggcttcgccagagctactggagtttgtagggcacatgagagatggcgatcaatcttttatttcccagtttgatgttcaggctcttttgcttgactatataaaacagaacaacctccgtgaccctcaaagaaagagtcaaattatctgtgactcaaggcttcaccgtttattcaggaaaacacgcgtcgctcattttgagatgttgaagcttttggagatgcactttattgtaagtgagccttctgcagtaaatgatggtagccaagggattatcaatcctgattcagctcaaatagatcatgccagtggatataatgacatggcagcaaagttctctcctgataggagacgaaggatgcatagaaagatggaaagagaaccacaggctaatcctgaagattacgcagcaattgatatgcataatattaacctaatttacctgcgccgtagcttgatggaggatcttattgatgatcccacattgtcagacaaaatttctggtgcttttgtcaggataagaatttcgggacttggtcagaagcaagatatgtatcgtctggtgaaagttgtcggtaagatatttaacctctaacatctatctatacagttattcatttaattgaatataagttttttgtgcagggacacataaggtttcagaaaaatacagcatcgggaagaagatgacaaattttgcacttgagataatgaacttaaacaaaaaggagattatcacgatggacacagtatcaaatcaggattttacagaggtcaagtcttttattttgttctcttctctcaatgaatgtcatatagcacttctggtgtctatgttggaacatgaattgatatgcaatttcattccttattttacaattttgtgttgtttgcagtgaagataattaagctaacttctactttttttataataataacatatatattttgatggcgcatattgatttatttattacaaatgctaagattattggaaatatgggactttccctctctcagcctttgaagaaaaggatttgtgttatatgtgcctcatcgtttcttgcatatcagaaattctctttcggtctgtggggtataatatttggttttgtgtgttctaaatgtgcatctagctgagctaccattggatttccttgtcatctccttctggctcaatggattgttcatatttatttgtgtaggaggaatgcaagcgcctaaggcagagcatgaagtatgatctaattagccgactgaaagtggtactgctagatgaaattaaacacccaatgatctaattgattttcatgttaacaagatatgtataggtttgatctgtgttatattctgtcttgttaattcagggtgatatccaagagaaagccaagatcttccaatttgtaagagtgaatgatgtgagcacaatcctactaaaggaaaattatgtttctagcttttccattaatatttgttttcttcaaaagatatatttatctgctactgtttaaattcttacagtggtttgaaaacgaaaagcagaagctgtgccatcttcgtgaccgtgcaagtgaaactgggcgtagaaaggaatatcctttttgacctttattatcatctgctacttttgcatttcttacttcgtctgggtttttttctttggctggctaggcgtggtgtttctcttcgaagagtccaaaccatataattgaagattcttaaaaagtttttagtgttgaggaactcttttaacatacacagatcattcataatctgttacgaaaatcttgggccggctggccttttattttgttgtttttctgtttgttatggagaaggcagagagacctcttcgttctgcccatgttaggacactatttgagccaagcagcttgagtttgcttgttttttatccttaactgcatcttacgcttagagaatgtgtggaaaagcttcagcttctcaacactcctgaggaaagagcacgcagaattaatgaagttcttgacgtgcatgttgactcgcatatggatcctgattatgaatctgatgatgaatttggcaacaagaaagctggtacttttatccttgagatgttaatgctctaaaattttgaatattatgctgcagttagtcatctggcatctgtaggatagtaacttcttgcactagtttatatttattgcagtttttagcattaaacacatttaacgtttggtaacattggttatttgctatgtgcagttgaacgtagtgtaaattgggcaagatcagatccgttcgtttcacccgttaaagttaaatattcgaacagttcacaaaagaatggtgatgctacccgccatctcaaaaacctgtctaaacaaaatacagagcgtaaatcaggagcagcaagaaactttgagaattcccattcaccagttggtatggatattccaaaatctggcactaatgtaaagagtaccaggtgtgaaactacgtcaccttcatctcatggggttgtatcaagtgacatggaaccagaaaaagtctggcactacaaggatccttctggaaatgttcagggcccatttactcttgtgcagctatccaaatggacaagttacttcccacgtgatatgagagtatggcttacatttgagagtgaagagagatcattgctgttgactgaagtgctctcaaagcaaccaaaagattttggtcaacctgcatctgttactacaagtagtaagtcgacagtagcagacactggacaaaacagaaacactgaaattgttgatctcaacaaagctccttctcctgttggttatagtatgcttaattcttttgaaaccactgttcagtctactaagcattctgctccagaaagggaaagcgtgaactctttagatgacaggttatcacactcgactgactcagttccaccaaaggacgctaacgcttcaaatagtcaagcaatgtgtcagatcaagcattcaggctctcttccatctcctggaagtccacatcaacgatcagacttgcaccatgatgaagtacagggaggacgctctggtgaatggaacaatcaacacaacagtgaactgtggagtccatccatgccgcagacaagttctagtgcacacagtaacgtggaatctcatcacgatcattatccttcgtggtcacaggttcaacatgatcctaaaaatagtttacaagcaggttctgggaaggatctgaattcgaggtatgatattgcgcagaaacttcctagtcaacggatcacgagagatgttcccagccctgtatttgcctggagtccatctgagtccaggactgcttccagtcaacatgaaggttcttgcttgagttcaacaaccaatctatgcactcatgatgaacttcattcttcaattgcttctgcaaaggctaaaagctttgctccagcaactcctgttgaagacagaggttcaagctcaccctctggtatgctgagtctctcggaaagagcaccaatctgcagtccacagtcagctccttctgcgtctgcttctgatacatgcaagatggaggagaacatgaatcaacaaaaaacacttgaagctgatatatcaaacacgtcagttaatcagtctccacagtctaagattctccctgaatcttctcctgataaccaagatgctgaacatgaatatcgtagtccacctccaatatctgagagtaaagagttatccccacagtcaaggactacccctggatcttctcctgataaccaagatactgaacgtgaatatcctagcccgcctccaatatctgggagtaaagagatatccccacagtcaaggactatccttgaatcttctcctgataaccaagataatggacatgaatatcctagtccacctccgataccggagagtatagagctatctccgcattctaaggctctccctgaatcttctcctgataaccaagatattgaacctgaatgccctagtccacctcaaatacccgagagtaaagagctatctcggcagtctaagattctccctgaatcatctcctggtaaccaagatattgaacctgaatgccctagtccaccgcaaatacctgagagtaaagagctatctcagcagtctaagattctccctgaatcctctcctgataaccacgatattaaatgtgaatattccagtccaactccgatacccgagagtaaagagctatctctgcagtctaagattctccctgaatcttcttctgataaccaagatattaagtgtgaagatcctagcccaactccgatatctaagagtaaagaggtgtctccgcaatctaagattctctctgaatcttatcttgataaccaagatgttgaacgtgagtgtcctagttccattctgataactgagagtaaagagcttgctgtggacctccctggatcaatatcattagcacctgaaaaaacagcttctactgatgtaggtgaaaactcttcacttgcttttatttttccaaaatctactctggctggggatgatgctttgaaatcagtatttgatatggcaaaggcgcatttagaatgtgaagattcaaaggttaaagaagaactgtatgttgaatcaactgttgttataagagatgacatggttgttaatcctgcctctggagttgagtccatagacatgtctgaaaatctcttggaatctttgatggagcaaagttgtggaactttttacatggatggtacaacagccttagaaggttttctgtctggttcaacgaaggaagaaccgcaatgttctagccccattgctttatccacatgctctagccccattgcattatccccttggggtgaacatggctactatcaaggagattctgttggttcttctttatggggtgtccaggacgatgatccaatcggtaatatttggccattatcctcacaagcaccggctctccagtattcatctggttagtctgttgatgtttagcatgcatccattagtcctaaacagtttgtggtgtttagcttacacctactaattttgcattgtaaaattctctctccagcaggtagcactgctcattttattgatgaagcaactgtcacccatggaaataatggagttgttctaagtagcacgccaggggaggaggtgggtttaccaaactcaggtgtttgcacagattggggattggttgagcaggtaatgatattccaacatcatgtcagcctttgacatttgctttgtgtatgacattccatttgacattgggttctcactacaataggtgaatccagaaacaaatgatgcatcggtatcaatgatagacaagaactcaggattagtagattctcaaccatcagcaaatgatggctcagatgtgggtactgcacggaacactaaccataatactaacttgtccctcaaccatgaaacagcggtacccttgagtagaagttctggagaagcatcaagaaaacacggatttattactgacttgaatgttgctacttcagaggaggcgttagggaacaccaagaactggaatccatatgctggtaatgctaatcggggcagccagcggaatcatcaccgtgacaggtactctcaaataagcgaatcttggcttcttagctcaaactactctaggagtaggtctgatggatttggcactggtggatcgtcgagatcaaccccaaggggacaaactcagagggggatatgtaaatttcatgagaatggctactgcaggaagggtgcatcttgtaactacctgcacccctgatctctgcaatagataacgagggtttgcattctttgcccatatcttttgacttttttgtatagcctaattacagtggtagtcaacatagagcctacacaaccttttcttggtttcattcaaccgtagcaaggacggagtatatgtctagctctagcataggaggatgactgaatgtactgcccaagcagattccactcttttggggacacggcctattttcgttttgcttggttcaattgaactgcatctgtgtatccctatccctattgttccccgcttttgtttcttcgaggcctgaggcctgacccgcatccgccagatgtatcggaaaatagcgatatgtaacccatcggtttagtttctgatttgtcttatgttgacagaatgtattcggtattagtacactgggttaggatagttatttagcattttgactagttataaatgatactactacttaacagtatacatgatgtgattgtgatattaacatgctgatactgtgcaccgaaatttggtagaggatggcttgtcgaaggtcagatatacaacagtacaagttaggcagctgattactgaatttgtattaagggacttgtggaatagtttatcggttgtcgtcattactcctgtatccagtgtccatttcgtggctctcttgtagccagatccattttgtgtctctcctgtatccatttccattctcaatggacagttgtgcggcaacgtaccactgctgtactattttgttttcttttttgagcgaaatcactgccgtactaaatgtatttgcaataaggtagcgttctctttgggccttttctggtctaaattcctgatttggcccagatacagttgggtctaagtttaaccataagcatctctcttcaagccaaggaacggaatcgcgattcacgaacacagattgtttgacacggccagaaacagcaagcctcaccaaccagacacattcgcctcaggctgagactggtttacagtttgaacgagttagtctgttacatttggttgtatatatagtctgttacatttggttgtctacatacgattttcatcgaatcctgcccacacgttactgtgcaactgttccatctgtttcttcgttggctgcgctcaggggaacaaaaaccggatagtaggtatttagttcaagatgctccagtatctgttgtgctgccgacaggtaagacgaatggccatcgacaagctccgtaacatcgacctgtaaattgcattgtacacaaagacgtgtaaaagatagatgaaaatcacgtaagaacacaagaatggcaccccagatgcttacattttcaacaccagggacatcaatggcctggatgccagccaacccttgtgttagcagactgcacgagaagattacttaagtcatagctcacatgggggaatggtgatatgagctttctaggagctctgaaatcataaatctgtttacctcgcacgaaaagtaacaccaagaatccagtcatctgtggagtacacattcacaaatcttccagcaaccatctgccatgaggacaagtgagtgaattaagcgccgagggaagaagctgggataaaatgaacagcaacttcactgtttcttgttgt

SEQ ID NO: 740 - DNA, 5772 bp, Oryza sativa; identical to SEQ ID NO: 514

SEQ ID NO: 741 - DNA, 4230 bp, Oryza sativa
atgataagcaacaaataacccataaaggacccatgtcatatatagataggccttgcaaacaaacaaaaaaaaggtatgcaaggaaataatagttccttcagcagttgagaaatcatataacagaagaaaaaaaacacattggtaataatttgacttctccactagaatagatatttttggatgagggaggccggcaaagaaactatttagtgacatggcaggccgctttggaacttttctcatgtatctgcactggctacctcacaccggaggttcgtaaaggcggaacggctaagggggagtgccaatgactggcacaaaaccgcatgctttggaatcccagagaacccaaccctccctttctcttttgcaaaagaatgtgcataaagagagagaggcagcatctttcctctgctcttttttgtttttccctttatttgtacatcatcacagtggcttccaattctccccctttgggcttagttccatctaagagatgtccattgaattgtttagggacaatcctaggaatgcatatgggaggattctattgatccctgtaaaatctctttagggacagtcctaagttaaaatggaacatgattacgacaaaagagaatcagtgtactcatcactaaaatgcaaagcttttttgcgcaaaagcgcgattgctttggcttaaaaggtattgacatcagttcaggttagatacttagatttagctcaagggcgccaattctccataggacccgccaaagtgcacaaaatctttatctgaaaacgacccctccattgaggattggcatcagggggtgagaagagaaacgctgaagcagcaaacatccaaaggcaaccacaagacaggcattgcagccgccgctcgccccccccccccccccccccggggatcgcgccaagtgtcaatcgctggattcgacttgacacccccttactattagtatactctacactcaaactccccaggacaaaaacaccgtgactttcccctccctagctccttccaaaaaacactcacaaaattccacaagagccatgcgaggtagaggaacaggagaagacgcatacacacacgacacatagagagagaggacaaacacaatagcttggatcgatagacttgtccatgtggtgcaagctaaagctactactaccacaagcaaggctacttcgttcatgaattataattttggtggcaacgtgttcgaccaggaggttggagttggaggcgaaggaggaggaggaggagaggggagcggctgcccatgggcgcggccgtgcgacgggtgccgcgcggcgccgagcgtggtgtactgccgcgcggacgcggcgtacctgtgcgcgtcgtgcgacgcgcgggtgcacgcggccaaccgcgtggcgtcccgccacgagcgcgtgcgggtgtgcgaggcctgcgagcgcgccccggccgcgctcgcgtgccgcgccgacgccgccgcgctgtgcgtggcgtgcgacgtgcaggtgcactccgcgaacccgctcccggccatcaccatcccggccacctccgtcctcgctgaggcggtggtggccaccgccaccgtcctcggcgacaaggacgaggaggtggactcttggcttctcctctccaaagattccgacaacaacaacaacaataacaacaacaacgacaacgacaataacgacaacaacaacagcaacagcagcaacaacggcatgtattttggtgaagtcgatgagtactttgatcttgtcgggtacaattcgtactacgacaaccgcatcgaaaacaaccaagatcggcagtatgggatgcatgaacagcaagagcagcagcagcagcagcaggagatgcaaaaggagtttgcagagaaggaagggagcgagtgtgtggtaccttcacagatcacaatgctgagtgagcagcagcatagtggttatggagttgtgggagcagaccaggccgcctccatgaccgccggcgtcagtgcttacacagattccatcagcaacagcgtgagttcatctattactagctgcaactatttttttttcagagaatgaacatctattactgttgttagttagttgttactacatgccacgttgtcaatgttttagagttcatactagtacttttgagtggaaaaacattctccaaacaaaagctactgtctaacaaaatgaagggataaataaacagatctcaacaagaaaacaaagatacttttctacttccaagctgcgatctttaggctgattaaatggaaccgataaaaaaaatactttaaagaaaagtacacaattgatctttaggcagaccagttgactacttcctgtatttctaagcatatacgatccatgctaactcactaattgaaaagaagtgagtttgttaaccttttatgtacacagcaatcaccacacgaaagacctcatgaaaagtaggataagtgtaagtgtaattcatattttatcccagtgcataaatttaaaatatcttacttttgcgacagtaaaaaagatattggaagtttttcttatgtatgtaaaattaaattaagcccatctatatatcattgcagggtctctgacacctgcaatctccttatgattcgcatatttcagtgaccatttgccgattccatctcagatatctttctcatcaatggaggcgggtatagtaccagacagcacggtgatagatatgccaaattccagaatcctgacacctgctggagcaatcaatctcttctcaggtccctcgcttcagatgtcccttcacttcagctccatggacagggaggccagggtgctcaggtacagggagaagaagaaggccaggaagtttgagaagacaatacgttatgaaacaagaaaggcgtatgcagaggcacgaccccggatcaagggccgtttcgccaagagatcagatgtgcagatcgaagtggaccagatgttctccactgcagctctatctgacggtagctatggtactgttccatggttctgatgggactcatgagacgctatcttataggcatatatatggggacttactgagtagcaataacatcgatccagtgggagtagttctagacaatctgtgttatgaataatagtgtgttgtttgcgacttaaaattgatcaagtaccttagctttttaaagttttgctttgtaatttccggatagcagatatatattgttggtacttgctcagtagctttaagtttttgaagtaagcaaagagcagtgatgagatgaaatgagtatgtgtataactgtatatagataattctagggtaccttggccaacaatcacagtagcaacaatgctttaggggtttaggtgacgaattgggggtttagttgtttactatgaagtagcaccaaaatggtggaacatatatattcctattttcgttccatcatgacatataactgctgtctaaccagcctatgttgactgaaaacaaagctcgtttcattacaaaataaaagatggaaccctgattaagtgtgtccactggccagatagtatcatagtagtataataatgaactggagttcaagtcttttatattccacttggatctcggtgccattttcttaatgatgtatcttagtgatgggctatcattgtatccggttggaatttcagcagaggtgaaggtgatggtgttcactcagcttttaaatatccattattcttacagccctccagatcattctggatgaaaagaaaagcagtgacaaagaatttactgttgctttaaccatgagaatcatatctttccagcacggcctatcttctcactaaaccatgagctatcggtgatcagtaactcgaatgatagttgtagggaatataggaacattgcctgatactgataggtacaccattgtggttgggtgatataagtacaacaaactcacagaaaagtttccctattattttgtgaatcaagagagcataaataaggaagctctttctcattctcagtgcattcctcttccctttcactagcaactagtggcatggatcttattgccttttgttttgagatggagcattcaccaaatatctaaggcatctcagggcaccaaccgcatatacaggaatacaggatacatctaatcgtttttggctaagcttgactgtatcggttagatattgcacaaaaaacagagttaggaattaagccctaagagatggtaattg

SEQ ID NO: 742 - DNA, 8539 bp, Oryza sativa
gatatgagatcgggttcgggaacgtagtatctgactgatacggattatatggatattacccgtattatgtttttgtgaggtaattttgatactatgtattggttatacatcgtattgtaccctatttatttcctaaggtcctaatagcctactataatcgtattatggatatataaaattgttaaataattattgtctatctgatatataagattgttgcttcgacttgatatccaaataaatattcgtaaccgatagtgtacgtaccattttggtacctatttgttccatatttttgctcgacattatctgagtttgtatccatattcaacactatccgtgtttgatccgattccaattataaaatatgggttaggatatgggaagggtaagatccgaccgaacccgacccgttttcacccctacacgtcgctaatctacacttcgaggcaaaaaaaaaagagagtaacaaatcaaactacaaaagcgcgcaatcgcatacacaataattaaatttgtatctatcgtcacatatacaaataaaatttgatcttgcatatttgcaccacaataaggtaatacctatgttttctactttttagaaaatttattaataactttttttagataatttatgaataactatttggaccacaggaaatagacaacgtagtacgacacattctttcctaggtcttatgtacgcatgattgtgtgtatattctcgcctacgccgacgacggtgaccggtgcatatgttcccagccgtcctccgccgcgcattgcggttgtggaggaagggagctccacgtctcgccatggccgtccacaacctgagttagatctctagctacctgatccccaaaccctctcaaaaagatgtatattcttcctagcactctggcccctggattagctcaaaaattcctcatatatatgctggctagctagctgatagtatatactactcataacccattcttcttccttacctagctagctagcaaacactgaagctgggagctctggctatatgtccatatatatatatatactacatcattgctatagctagctagctggaggaggaacattcatacttaattctagttacttggagtgagtttaaaacactgaattaggtgaaattgaccggtggccgctgactgctggcaggctagctttggtgattaattaattatctgtcggagtaagtcttatacttgatattacatgcatggaagaaggtatatatgtctacgccaacattcatgtacttagtcctctactatttctacatagttaattacaacccaccattaactgtattaattacttagaactctcacatttaaccacgtcatgatcatatcaacggtgttatccatcaattgaggtgtgtcgtctatgagatatcagcaattaattaagatcaacatttctcagcaaaggagctttaaaaccctgctgcaaatatgcaggggtacgtatccaaatatatcatatacccctgtcgtatatagtatttacatgtagttattgatgatgatagattgctcatgcatggaggtgattatttcttgtgtgtttggtttgttttgcctggaaatagctatagctttgcacatatagctgcttaaatattcttgaatgcagacatacgagttttcgatatatactcagatatattagtacaatattattatttgtatgcatatcatcagtgactcgattgatatttgaagatatatacttatataaaaatgcaaggatatatgcatgaagaacatgtccatatatatatatatatatatatatagagagagagagagagagagatctgtgtctagcttgcactacaccatatatatatataacctaccttagccaaaggagtcagttattaactgtagttagcattattgttgaattaatgctatacctcattaactatatatggtgcacgcgcattccatgcatcatgcatgtttattactcgtcatatattatatacgatgtaaacacaaagtacaattgattatattattgttaattatttttttaaaaacggagaagcagatgtagtcgttaatttttgttttctcctaattaggttataataatggatcaccgagagctgtggccttatggactaagagttctggtcatcgatgacgactgttcatacttgtcagtcatggaagatttacttctgaagtgcagctacaagggtaaaataccatctatacaagacacataattaattaacaaaatctaactatctagcttggcatatatagtgatcgaatatattgatgcgaattaagattatataagattatacatataaaatattgagtttttctggattaaatagaagatgcatacagaagttacaaacacgcaccactacacacgtgtccatgcacactaatgtgtctcctaatatatacatgctcagatacgctcagatagacagatcagatcaatggcaaatctttgacctcactaaaatcctattggaagtatgtgcataaaatttgtaaataaaatttgtataagatcattaatttttctactatttaagttcagtcagtttcacatgcataatacatgataatcctatattatgtatatatatcattccatgcttactttaaccaaattttccctctaccttggtgtagccaatgcatcatatagttataatatgttatgaatacataaatatatagcagaatttatgttcattgtcacataaaatgtgtttgcatgattcttattattaaaataaatatttggtaatgtgtttcagctaacaggcacatggaatatagtcaaagatgatcagctctgtggttggactgccatttgctttgaagaagctacaaaaatttaattaattttgaaaatgaaataaaacatgcgggagttctatatagtgtatataccttaaaataattcttttctttcttcccatttagtttgtcaaattagactgcaagtagtaattaaatcgaagtcttggagggtagtgcagaacatatattaagaacaaaggtatactttaattatatatcctcaccttgcagttgcggtttctagggttagcatatattttgtgaggtgtcaactcagatattgtgatgacaaattaacctataaattttctccatatgtttttattcaatgggcgatccatactccataaaatgcatattaattaatttgtaatgaaaaccgggaaaagttgtgttcgtatatataccaagaatcttgcaagaaagtgattgtatgtagtaacatttccatacacacatgaagttacacacacacacacacacatattatatatatatatatatatatatatatatatatatatagtctaacgtcaaaaatgaaattcttctagatatatcttacaaatattcgatattggcctcattttctttgtgatgtatgtaccttatattagtattctcttgtagttacaacgtataagaacgtcagagaagctgtgcctttcatattggacaatccacaaatagttgacctagtaatcagtgatgcgttctttcctaccgaagatggtttgctcattctgcaagaagtaacctccaagtttggcatacctacagtgagtaagtaatttatttattatctccttacacattcttactagtttatatggattacacgccttaacttatgcgtgcgtgtgtgcttgaggaactaggtcaaatatgcactaatatataataagctactcactccgtctcaaaatataactactttcgctacgcgcgggtcaggtcatctgtgatgggcccaaaccgtacctctgacaggttcggccctcatcagagattagtggtcagcctactcacctctgacgggccgttagaaatgggtcgtcacaggtgactcacttgtgatgtgtggctctttccaacatgtcagaggtgactgtcacctttgacgggttgtattttatcacttatcacaggtgtgaaaaaacaacccaaaagaaaaagcaaaagccctcagccccaagctcacgccaagagcataacacaacatctttgcattttattggcagatctgataacatccaagaaaaaactacagatgaaacaaaagatgtatgatacatatcaaacttgagtaacaatatacatcacacaagtaatgatctccatcctaacaaactacacatccacacaagtaacaaagaatatggcccaatctgaaatttggcagtgaacatttgcaagatatgaaatcaagaacaacctacaggagtgtcaaggtcagggaggccgccgtgctccccctccacccctgtcagatctacccaccaactccaccaccagatctgccaatcctccagggtcagagaggctagatccacgctcgaggagagcctagatccgcacttgtgatagggacggctaccattgctttggactggagaagacgaggaaatggcatcaatgatcggggaggctagatctgcacccgaggaggcagctggtgcttgagggtagaggagacagcggccaacagtcggatcgatccatgtcccccgaccttgtggaggctagatcccacggtcgccggatgctggcggagatgggggagcccgggctcgggggagaggccggctccggtggccggcggttgggtgataaaggaggaggcggccaacagtcaagggagaggccgcggcggccggtgattgggggaaggaggacgcaacggctggagatcggggaaaggaggaggcggtagccgaatccacatcctggaggcaagatccggcgaccggtgatcaggaggcggttaggggaagagagtttgagatatggggataaggatgagagggagaaagtgagcagatgtgaggagaagaaagaagagagaccggaggatgggaggagatgggaagggagttgggccgtacacatggggattgggggattttcctttattttaaattatcattgacgagcataagaatttaacacgttagatatgaggtatcacatcctgtgatgaggtgcaaactcaacacccgtcacagatagaaggtcatatatgacgggcctatatgtgggcccgtcaaagatgttatgtgtcgagtcctcataaatgtccgtaagatgagtttttacttgtgacgagccatccctttgaaccccatctacaactggctatagttcaaccctatcagaaataatatctttcgtgacgagacattggcctgtcacagatatgccgtcacaatgggctgctctagtgaagtgttcgagaattcaaattcgtctcaaccaatcacaatcatttaatttattcacctatttttttatctcaaccaatcgcaatcatttttttataaatagtaatattttgagacaaaaggatcggagtacaccctaataagtttactcacaaggaaactttatatatgttttttaactagttatggcttcaagtggagacacaaatacagtgatgaaatatgttgcaaatggcgcttttgatttcctgctaaaacctgtgaggatcgaagagctgagcaacatttggcagcacatattccgaaagcaaatgcaagatcacaagaacaataacatggttggaaatctcgaaaaacccggtcatcctccatcaatattagccatggctcgtgctactccggctaccacgagatcaacggccaccgaagcttcgctagcgcctctagaaaatgaggtgagagatgacatggtcaactacaatggcgagatcacggacatacgagacctcggaaagtccaggctgacctggaccacgcagttgcaccgtcagttcattgcagcagtgaaccacctcggagaagacagtgagtgatcaaattaaacttctttgcagtaccatttcaatcacttttcatatgtatacatgcgtgtatacattaattttaatttactagtatatatgtatttcctagcttgttttaagatgtggtaattatgtgtaatttatttgcagaggcagttccaaagaagatactagggataatgaaggtcaaacatttgacaagagagcaagttgccagtcatctgcaggtaatatttcagtggctcattgcaagatgaaagcaaaacctatcatgtttttcctttcaagatttctttacgataaattagaccatatgcaagatatatacaagggcaaattccctccagagtttttagaaaacactttccaatgtataatatgtaaaaatgtgttgtccatgttacaatgattcttaattatactactttcacaattgtacatataaattagcctaatactactcatacatatgtatcaggtacacattgtaagtttatatatttgcatcactctaatgtactccctagctctgtccatgaatacaagggattatacccaattaagaagaaactaagaaagtgggtaaagtacgcactgctgctcatgatggagtattactagtagtacattctctctatttttttgggtagggatgatggggagtagtgctagtagattttttttctcttttttttatagaaccgatggggtaaataaatggaagctgctgatatatgaattactgactattgttctctttgctttcccaatacttatattcttgataaactagaggcagggtttgaaatttcgaaattggattttatgtcgggggtgaacgaaattaccgaaaatttctggccggaattatttgaaaatttgactaaattcacaaaaaaattgcaaaaaaactgaaaattttaggcgagatttgagcatgccggtggagggcaaaattaccaaaatttcggaaaattcgaaccgaaatttcaaaccctaactagaggatcataatcatatttatggacagagggagcatgaatgaatatgaccgatgcttctagggtttccttctacaagcatcctaattagcttattcaagttagagtgcatccactgcataacttctttcgctgcttcttcagctaattcagttgaacatatataaccataaaacctaacatttgaactgatgcagaaatacaggatgcaactgaagaaatcgattccaacaacaagcaaacacggagcgactttgtcatccaccgctctcgacaaaacacaagaccacccttcaagatcgcagtatttcaatcaagacggatgcaaggaaatcatggactactctttaccgagagatgacctctcaagtggctcagagtgcatgcttgaagaactgaacgattactcatccgaaggtttccaagatttccgatgggattcagacaaacaggaatatggaccatgtttttggaatttctaggtagagaatataatgatcccatcatgtctcatgatccacatccatatgttgatacctgcaattgactttctgaataagtgaacattaccacatccatatatactcttgatgttcattgcagaactaaactgacaacatactgtacataggttgtctactctatctagatgtgtcacatgcaaagattatgttgataacattcatccaaatcaatgtccatcctctcaattatgggtgtgtttggggaagttttagattctgagaagttgctgaagataatacatgcatctaggtggcgacaatctagagatgtcgaggaaaccaacttttggcttatagttcattttctggattttacgactacaatttcccaaaatatggacaaaaagctatatattcctacatataagatccgtaatcagaaaaaaaaacaatatatggatccatatacattatatatagggtaattttaccatgcttaagaaggtagctataagtacatgtaaaatttggtactttaggtgtagtactactgagtactaagtacctcaagtaccaaagattttcatgtaaaatttaggtatctcgatacctcttatatcacatagcagcatatatagagcaatagtaattaagtaacaaagtgatcaaaaatcaaaatgaattgatattaagaaaaccatccgtgagcatgatctccataaaacaaaaactcttgctacctgcatatgcacacagcaaacacgcgtgatgtttatatacttgacccctcgatcgatcccaaatatacaagattgggttatctcgattaaaaaacaaaacaacactttattttgcttttctcgattcgttgtttctgcattaatgaagaattaactcgattgatcgatcgtgtctgacacaagcattgctgcgagaagaatcaaaaaaaaaagtttttggagcttttgttcgatccattaacatatatgaagctgcatggatgtgtggatcactatctaggccgtgatgatcatgatcaagcgaggagccaaaagttcttgtgcgtcttggtgttgagcaggtagccggcgttctgccccttcttctgcacactcacgcacacgcacttgctgtgttcgatcaagaactccgccgtgctgtcgtgcgctcggctcgacccgctcgggc

SEQ ID NO: 743 - DNA, 9397 bp, Oryza sativa
tacatataccacttttcaataaatatttttatagaaacaagaagtttaaattgtgttttggagactgcgccgctgtccaaaacgacttactttagagcaaggataatagtagagctcacttcttactattagcacatcttaaagcctatagtaacatctgtccaaaacgatttgttttgattttttgttatctccctcctccacataagcttatagtaagtttatagctcactattatacttgctcttatgagtacggaggaagtacttcctaaaggatccagagaaatcttgttgcgcactgttgttgactgatcgccattcgtttactttcacgatcgattgacagatgtactactatttggaacgaaagattttttttgaaacaatttcagaggactcaactaattcatgggaaggagcacctagtttttatcatgatccttttccaaaagagttacacagatttgcacaagcatgttttgtttcactgtgatctgtgaattttacaaaagtacgtaggatttcttgtttgacggcggttacgctctagtacactgaaagtaggatgctaacaaaatgcttatacttttggtcacacaaacccaacaattcaacctttacaacaagcagctaataacacgacacaacattaatcaaatccgaacaatttcatcaagaaatcaaatccttggcgagaaacaaacaaaaggagaagaggcgctagagtttcaaaactggaggaggcaacggagcgcacaaaatggaccgtattaaattaaagcggtccactgcgacggcccacatgtcaaggacatcccccactagtagggcgtggtgctttgaattgaactgcgaggagggggggaaggaagcagcagcagtagtaatcaccccctggccccacctgtctgcgacccaacctgccccgcccggccccaccacccagtctcctgccacctgcatgcgctgctctgcgcgagccaagccgactccccgcagcagccgcagcagcagcaaagcctccccccccaacccaccaccgcgacacgcacgcgagcgacgcgagcgctccacgatttctctgcctccccccccccctcggtctcctcctcccccaccaccaccgcacgcttcccgaggcgccgccctccgccgccgcgggcatccgcttccgacgacgatgtaagccgctcttctccgcgctctcgctctgtgttttttttttttttgggggggggggttgatcggtgggggcggttgcttgaggcgcgatcggattgcggggcggggtcgctgacgctggggggggagtgatccgatggggttgaggagggccgattcgggcgctggaaatgggttcggtttcgaggatagatgcttgcctcatggggagctttattgcggatttaggaaaaaaagcgtggtttgcgtgggattgggggatttgtggcgggttgggattagtttaggattggtttggtgttggattggtggtaatctggaggtaaaaggtgggagttttttttttcctttctgggtggagatcccctgcggggtatcgggtgatggagatgctcgggcttcttttagagcgccgatggcggcattcgattccgttgaaagggcagtggtggtagcaaagcgggctgcgtctttaagggggggggggggggggctcgcgatggcgatgaatgcctcagattgattccactccgatcttttcctattcccgattcattgcttgattgatttgccatgacatggtgaaggaacaatctttgagctgaaatttgtttatgtttgtgattgttgtgcctgctgtggtttccttcatcagtgatttattcttgttggatgtttttttttcatgcggagattggaaggagcaccgaagggtgtagcacaaggccgagttgcatggggcgataatgccagagttgcggggtggtgtttggagagctcgtctgaggtccaagaaggtttacgacgtccaggacgcagatccagctgcgagtccggtgtcgccagctccgcgggggaggactggaaggcgcggcggtgctgcggctggcagaggcaacaagacagttgctgagggaggagggaggaaagctctgaagcctagaggaaaggggtgcagggctgttgatttgtgtaaggatcaaccttgcaaggacctccctgaagttattgctagaaaggcggttaccggcaaagcccaggaggaccttggtttgaacaaggtagctgacagagctgcgaacttgatgatggacggcgaaagtggagacaaatttgctgcggcagaagatgaatccactacaacaccagttcctgagcgggtatggaataccttcttccctttgcacttctgtaggtgtactatcatttgtaccgataaagtcattttcttcaagttctttaacatgggatgtttcatcatttttgtttactttgtttggtagtttttgtatggttgctgttccagatgttcatgttacctttcacagatgacttctctgctgtattggtgttattagacacaagacaaccgacatgtctgtttcacataaaatatagtgtaaccaaatttagaagttataaagtataataattgatgatgattcatctgaattgtggcgtaagaaatggtttagttgttatgcttgagaggtgagtgcctatttgcttggcgaagctgagattgaggcactgaatggctggattatagtagttttgttttgtagaggaaacaaacttcagataatcacatagtatcacatcctgatatcacaaaaccgatgaaactccgtggcaagttcatcaaacaacaaagtttaggaatgggaaagttacaatctcttgctctttgacatcaaattttatcactaaaataggagtttgcttctcctggtgacatcttttatctacactttatgtggcagagtttcactgccattaattaacctcctaaaattctaaatagttatatatgttttacaggttcaagtaggcaattccccagagtatataactgataggaagttgggtaaaggtggatttggtcaggtctatgttggtcgaagagtatctggtggaggttctcgcacgggtccagatgcgcaagaggtttcatttcttaccacctcaattggacactgaagctctgttagtttagttagtttttagatatctgaatgaatatcctgtaggttgcgcttaaatttgagcaccgaagcagtaaaggatgtaactatggccctccatacgagtggcaggtttaccagtaagaatttcacacaatctatcccttctgatgtttatgttgttctatgtggagtatgatccattaaccttttgtccttttgtaaatagcactctcaatggttgttatggcataccatcagtccactataagggtcgtttgggagactactacattcttgtgcgtttaccttagtcatgtattgaaaaatgtttctggactcaaaataaattattttattcaaccatcacaccaaaatttcaggtaatggatatgcttggtcccagcctctgggatgtgtggaattcagtgggacaggcgtaagtttcggatcacctttttgcattgaccacctgattttattactcctcactgaaaataacagcattggaacttgcaaacaggatgtctgcccatatggttgcttgcattgctgtggaagcgatatcaattcttgagaagcttcactctaaagggtaaaatttaaagtcacttgtgcctgaaaattatatggagctgcatggaatttctcttttgttttctatttcattggtgttaacatttccagtgcatcttatcattgccaggtttgtacatggtgatgtcaaaccagagaattttttgcttggtcatcctgggtcagttgatgagaagaagcttttcctgattgatcttggtttaggtaggcttttgttcaaagtagtctcatctgtgtatgaagtattcaatttagttctcaatgtgctatggcatttgctcttatgcattttgtacttgaatcccaaggaattgttgccctgttgatttatttttatttcgtgatgttgaaatcatgcagcatccaggtggaaagaagcatcatctggtcagcatgttgactatgatcagaggccagatgtctttaggttcgtccatttttgtgtgtgcactataatatctttttctctgtattaaattatgggcaattattaacttacctttttcttttcgacattttacaggggaacaattagatacgctagcgtccatgcccacttaggtcgtacaggtagcaggagggatgatttagagtcactggcttacaccctaatctttttaataagagggagattaccttggcaagggtatcaggtagcctttaatatgctcagcaaagttttgacataatgttttcttctatttgttgaacttattttagtgttaatgggatggtaatgcagggagataacaagagttttcttgtttgtaagaagaaaatggctacttcaccagagttgctgtgttgcttctgtccagctccgttcaaacattttctagagatggtcactaacatgaaatttgacgaagagccaaactatccaaaacttatttctctctttgatggtttgattgaagggcctgcttcaaggcccatcagaattgatggagctctgaaggtatgtaaatgttgtacacacaacctgtgtctgtaccatacagattaacttgaatgcgttaaattttctcatgtatatttttgcatattataggttgggcaaaaacgtggaagaatggttgtaaatcttgacgatgatgaacagcccaagaagaaagttaggttgggaagcccagcaactcaatggatctcagtttataatgctaggcggcccatgaagcagaggtaatgccctaaaaactgaaaatggtgcaaagtctctgtgtctgttatttattttcccaaacattgtcctcgcaatgcacttgcctttaagtgtggacgcacttgcctttaagtgtggactgagcacataacacgatgctatccagttgccaccagacactttacaactggtctgttctgtttccctgatgtcaggatctcataaggcttcttatcactatgatattacgcaaactgcttttgagttatctccgatacattttattgttctaactacattttatatgtctccaaatttgctgggttaagcaagagttcagtgactaactctgtcttgattgatgttgtcactggggatagttcctgtatgcgcctagtgtcatccattttagcatggacttaactttacctgattcctggcaaaagcagcgatgtgaaaatatcatccatggcgttagctgaacccttcatgctagttttagtgatggaagtgtttgtgtgtgtgtgcgtgcccctgcatgcccatgcttattacaatttcagccttcatagctcttatttctttggcctccttgttctagaatttgagtttttgaagtcaacctagttctcagctattaatccatatatttatcctctttaaaaattaaatatgatatatattgacgtggctgcaaaatgcatcacttctttctttacagatatcactataatgttgctgattcaaggctgcatcagcatatagaaaaaggcaatgaagatgggctgtacattagttgtgtctcttcttccgcaaatttttgggctctcataatggatgctgggactggcttttgttcccaagtttatgagctttcacaagtgtttctgcacaaggtgcactggctatttctccaccccttccatccagttttgatgaatccagagtcctgactccatattaccttgtttgtacataggattggattatggagcagtgggagaagaattattacataacggcaatagcaggagcaaccaatggaagctcattggttgtaatgtccaaaggttggtaaaataccttttctctgctggcaaactaattttactaccttggctatttcttagaacttgaaacaaccccgttgatgaatatgaaatagttgaaacagtcagttgctttaagacagttttcagcagaacctcttgtgcagcaagggtatgtgccttgcatactagactgattgaaacatgagtgtgttgaaggcataacctgcaacaacttcataggttaaaatgatttgtgtagactgtagagtgtgatcctttttatttggggggacagccaccagtattgcctgctcaattgctcggcaagtagcaataattttcgtttcattgtgtaaaggacgaacaatcagatggttcctgttaaaactgtgatggttaacagtaggtttgtaagtaggcatttcgtccatgctctcatcagtccatggcagcttgaggcagaatttatttagagggtgccacaagttcataacatgaatggcagacagacatacataatctgtctctataatacacaaatatctatgaactaatatttggtttggccagttttgatcaaaaagttgatggatcaattttgttaccagttttcctttgcttcaacacttaaatttaagagtaaatttcacaaaactacagatatattgaccaaactatcacaaaactgcagatttaacaccaaatttatcacaaaactacaggtctaaggtggagtctcacaaaactttagatttagtaacaaagttttcacaaaactacaggtttagcgtcaatttaatcacaaaacttggacgttttatgactcaaacataacattagtgctaaggatttaaaccccaaaaattgtagttttgtgataattttataaatgtgtagttttgtggtacttagccttagacctgtaaccttaaatctgtagttttgcattaatttggtcaaagtatctgtacttttgtgaaatttactctttaattttgtatttctactctcaactgtctggactccaatttttcctgtgagcttctggtgtccttccattagatactatcgttctaaaccaggcatgtatcatcattacaggaactccatacacacagcagtcatacaaagtcagtgaatcctttccttacaagtggattaacaaaaagtggaaagaaggtttccatgtgacatctatggctactgctggaaaccgttggggagttgtcatgtcaagaaatgcaggctattcccatcaggttaaaagatttcgatttaccaatccttgtgttcattctttctatgaatttggtggcttctcatatgccaaataacctgtacgtgataaaaaatggtatatacaccttgattggtaaagaatatccaacgataagttactgtcgataggctaacctcaaaaccatcagtttaagtgttgcgtgcggaaactacctaactccaaacttttgttgctgtaaggatgtcatcttgtttgtggttgaattcgaacattcaactggtagaatgcttgatgtaccaatcagttgagtttgtgctctttacagctgttaaccaaaaaagcagggaaatacagtaaccacacatgtttctattctgaattttcttacatattatcttgatgttcagactcctgagttgatcactgcttcatagtgagtaagtctgaaactgaatccgtctcgcaatgtgcaggtggtagagttggactttctatatccaagtgaagggatccatcggcgatgggagacaggttacagaataacttcgactgcagcaactcctgaccaagctgccttcatcttgagcataccaaagaggaagccaatggacgagacacaagaaactcttcgaacttcctcctttcccagcaaccatgtcaaggtacatacatcttcagctctcccaacctcacaatgccatacaaaatcttatgatgcgtcgaactttttttgacggaaatgatgcgtcgaactaacattgctgttaaaatctcaggaaaaatggtcaaagaacctatacatcgcttcaatctgctacggccggaccgtatgctgacagcttcaacatttcgaagctccaatgtgaagccatgtctagctactactagcattttgcagtgagctgccaaccgatcaaatctcccttgattgggagatctgaagcaaggaaaaaaaaaagaaacaaatcaatggctgacatcaccggcctcttgcagccatctattctaactgtaaaaattgaaaaaaaaaatcatggcaaatgttgtaccagatcggatatggagacctttgtccataagctaagctagtataagctgcatggcggtgctaagatcatattgttctcacatacggagtatatatatatcatactactctctctgtttcagattataagatattttgactttggccaaagtcaaactgcttcaagtttaactaagtttataggcatatatagtaatatttatattaccaaattagttttattaaattaataattaaatatattttataataaatttatcttgagtcataattttactattttttctataaactttgttaaacttaaaacaatttaactttaactaaagctaaaacatcttataacttgaatcggaaggcaggagtataaatttattttagaataaatttatctttgcatgtgcattgcgttgcagcgtgggcacgcggccagccggtgatgaggtgtcgctgcattacgctcgccgtgcatggggacggccggccggtgcacggtcaccgaggccggccagtcgccgtgcttctgctgctgctgcgaggaagaagatagaagagagagggaggaggaaaaaaaaaaaaagaagggcggcagcgtcgagaagcgaatcctggattctgcatgctccacgcatgatgggttcctttccgaaaagccgtgatgatgattggaacgggcatgtggttactgtgtgttggacgcagtaatcaatcatcagggttgcagcaggcagcctttcttattttactgatttttgtaaccagcaaataaagtgcctctctgcataagaacattcatcggttttactggtcagttgcctagctaaaaaccatctaaagctagccatacctgacaagaaaagaaaatgattcttccaataccgttagagcaagtttaatagtatagcctactactagttccaattcatctatagctaatttaataacttatctatacaatagttacatactacactattaatacatggtctcacctgtcatacacacactgtgtcttggagtccgtgctatagctgactacaaatctatagcccgctgctcttatctctctttatttatcttcttaaaatatgtttgtggctggcttatagcctgctattgtacctgctcttactgctcgtttgtgcaacac

SEQ ID NO: 744 - DNA, 7021 bp, Oryza sativa
cccaggggacaatagtgtcgctggaagcgatttggtaggatcaggatctgagcgagacctctctctcatcatgttgttggcatcttgggcatcgcctatctctcccatcaaccggatgcatgagtagaaggagaccaataccttctcttcctgccgccaggagcagttccatcaccgtcgcactctgtctccttgatccggtaaaataggggttgggtgtcgatagcgggaacagttgattatggtgcggtacaaatttccatataatatatattttaaaaaaagataccattcaacaattcaaaatagtatgctcatggagagcgataaaagaagtagctaatccaaaagagacaaatctaatgaagcctaagagcaagtttaatagcatagctaactactagctccaaatcatttatatccaatctaataatttattcatacaatagttatctataaatatatattataccattaatgactgatcctaccctctcatacacagacaacatcttaaaatccatgctatagctggctagaaatctcacttttcttcactctcttctcttacctttttcacatattcttataaagttatagctggtttatagcatactattatacacaggggcggatctacagtatatgggccggtgccagacgacaccgacgacttttgacaaaagctatagcaaaactgcttatccatatattataacatcatgatctaagcataactagcatactatgacaccgatatatatgttatgacaccaatgaattgattttctagacctgccactgattatacatgctcagtcagaaaaatgtgcttcatgatcacggtttaaaccggttgtcacactactgaatcggtgatcataaagcctataaaccggctcagtgaccggttcttttttcccaatgtctcactcacggtgggcccacctttcactcctccaatgggcgtatggatgagcatggcatccagatccaagagaaaaaaaaaaaaagcaaaacaatcccgtagcttccatttccatggccacaaaaaccggcgacctcctccaccccgccatggcctgacgcccccgagaagctgctgcggcgggaggcgatggcgacgaggggaggaggcggaggaggaggagggaaggaggcgaaggggaaggtgatgggcccgctgttcccgcggctccacgtcaacgacgcggccaagggcggaggcccgcgggcgccgccccggaacaagatggcgctctacgagcagttcaccgtgccctcgcatcgcttcagcggcggaggaggcggcggcggagtaggaggcagccccgcgcactcgacgtcggcggcgagccagagccagagccagagccaggtgactcgacgtcctgcccgtatgatcgattcgattgggggtagtgtgtgcgactgctaaattggtactagtaggcgacaattctgtgcaaatggagctaaacgccttgcaaatcgaatcgaattagaagcctaaattggtaggcaataattctgtgcaatggagctaaacttccttgcaaatcgaatagaactaaaagctgggaagataatttcgaggcacaaatggtgccctcgacgtcgacgagctaggtcagagggggcgtttcacgccttaccctttgtagttatctcggttgggatagatgaattgatgggcgaatttagtgcaacggagctaaacacatggaaaaattggataagattaaggccgagaagcccagtttgaggcacaaatgccatgttccttttgtgctgattaatctatcatgccgtcgacatgtgattcaattacttgcaaatatagtcatacaattgtggtaggagtaacatgcttgcacgttgtcatagtgtcattattgatctttctccgtgctgataactcacttgtgttgaaggcgaaagagcagaacaaaaccattatatgcagtttacatcagctcttccggtaaagttttggagacggggcataagttccttgcaaacaatatcggatattatagcttattgcaaattgtatatggccagatatgctatgattgtgtttgctgaggtctggtgtttgtaatatacaaacaaaaaggtccacatgtgaaactgcatgtagcgcaggtggcaaagagtagccgtagtgctgctcaacgtactgtgttctattctccctgacgtgctcaccttccttaaatcattgacactaggttcctccttagtgtcttgcatttttgcctgccgaaaaaaaaaggtccacgtgaaagggaatgataaaaatggtggttgatatgctttgattgtcaggcacacgttcaacctgtatgtgataaatatcaacggttttctaatactgttttcagcaaggatttaggagtggaaaatattctttagaacaaatctgcaatagcctcccacaacacatccaactaccttttgataatgggatagttatagacatgaagtgcgaatggcaaaagtccaagtcatagatttccaaatgaagaaatgtgaacaaaataagaaagaaagaagtccatttgcagtattatgtctcttttgcccttctttgggtcgaaaataaaataaaaaatcgagatcttaccatgagatacttaatctcccaccactttttctaattcaacatggaagttcttggatagtttaaatacgcttcctaccaattagcgtggaatcctcgcaatttttcactaaatctagtagtactgaaatggattttattttcttccaggtttatggacgtgacagttctctgttccagccgttcaatgtgccttccaatcgacctggccattctactgaaaagatcaattcagataagatcaacaagaagattagtggttcaagaaaagaactggggatgttatcctctcagactaagggcatggatatttatgcttcaagatcaactgctgaggcaccacaaagaagagcagaaaatacaataaagagttcttcgggaaagagattggccgatgatgatgaatttatggttccttctgtcttcaattccagatttcctcaatatagtactcaagagaatgcaggggttcaagaccaatcaacaccccttgttgctgcaaatccacacaaaagcccttcaacagtgtccaaatcatccacaaagtgttataacactgttagcaagaaattggagagaatccatgtttctgatgtgaaatcaaggacccctttgaaagacaaggagatggaagcagcacagacatccaaaaacgtggaagttgaaaaaagttcatcctttcatgcttccaaagatatgtttgaaagcaggcatgctaaagtatatcctaagatggataagacgggcattataaatgattctgatgagccacatggtggaaatagtgggcatcaagcgacaagcagaaatggaggttccatgaaatttcagaaccctccaatgagaagaaatgaaatttcctctaatccatcttctgaaaatactgataggcattataatttaccgcaaggaggcatagaggaaacaggtacaaagagaaaaaggttgctagaacaacacgatgcagagaaaagtgatgatgtgtcaaggttgctagaacaacacgatgcagagaacattgatgatgtgtctgattcctcggtggagtgtataactggttgggagatttctccagataaaattgttggagccattggtacaaagcatttctggaaagcaagacgtgctattatgaagtaagtaaaactatccttttgagcttagtttggcccactcaaactagacttgtttgcagctctaattacgtataggtagctttgatgaataaaatttgttttgtttcccttgctttactgttatttgctcttaatttgcggttgatcttaatcatcttagacagaaaaacatgatgactatctcgtttgtttttggtttatttcatatttgaatgccaatagatgtcagctccagatgatatttcaaatacctcatgcatggaaactgtgcatacttatgccaaattttgggcttacaagtcagcatgtctacaaatttctttggcagaattaatatatatctagttcaacatttgctgatttgtaattggattagttgtctgcagaatgccggcatgttttattttcctttcaactaggtcaatcagttttgttgttgtctgttgttcttgtccacctacacctgtactactgaaatgttctcttttggagatgtcaatgaaaattttaatctatagtggtttcaattttattttcattttagtcaagaagaatggcataatctcatttaaaaagattgtaaaagtgtccctgttaaagtgatattgtaggtattgctttaccaagctactgtatgattccctttattgttttacactctaatcttctttaaactctatgcagtcaacagagggtgtttgctgtccaggtttttgagctgcataagttggtaaaagtgagtctagcaaatttctcttccttctagccactcttaagcaggttaattcgtggataggattttgtccataatctgtttataacccacacttgtatttgacttacaatcaggtgcagaagttgattgcagcatcgccacatgtacttattgaaagtgatccttgccttggcaatgccttgttgggtagcaagaacaagctggtggaagaaaacctgaaagcacaacctcttttagtcgcaaccatcgatgacgtggagccaagtctacagcaaccggaggtatcaaaagaaaacactgaagacagcccaccctcccctcatgatactgggcttggcagtggtcaacgtgatcaagctgcaacaaatggcgtctctaaaagcaatcgtcgagctacacctgttgcttctgataacaaacaaaataactggggcgttcaacttcaaccacctcaaaatcaatggcttgtccctgtcatgtctcctttggaaggccttgtctataagccttattctggtccgtgccctccagctggtagcatattggccccgttttatgccaactgtactcctttgagtcttccatcaacagctggagatttcatgaactcggcatacggtgttcctatgcctcatcagccacaacatatgggtgctcctggccctccttccatgcctatgaactacttcccgcctttcagcataccagtgatgaacccaactgcaccggcacctgtagtcgaacaagggagacatccttcgatgccacagccttatgggaactttgagcagcagtcgtggatctcatgtaacatgtcacatccaagtggcatttggagatttcatgcctcaagagatagcgaggcacaggccagcagcgctagcagtccttttgacaggttccaatgcagtggaagtggtcctgtatccgccttccccacagtatcagctcagaacaaccagcctcagccctcatatagcagccgggacaaccagaccaatgttatcaaggttgttccacataattcacgaactgcttcagagtcagcagcacggattttccggtcaatacaaatggaacggcaacgagatgattgatagccatgagaactggcaattttatgctggatgcatttgatgacttggtaaatgtagagaagaggtttgccagattatggtgacccctatatttatcctgaccgtttatagacagatgatgatactgtatattctcaagggcgggctccgtcagggtgatgtcgccccttcgtcaatttgtaatgtattttgtacagtaggacaggacagtatctgtttaactttaacgctatgtaaagccattgctggtcagttaagcagaataatactaaagctaatgagctggggaaaagaccccgctctttttatctctttcttttgtgaaccctgattacgagttaaggccccgcgccatttgtggggatttgctcttataagtgtgtgatctatattgcaaacagaatggagatatatgatttttggatatatgtaatgtgtgccagtattttactgatgaaaccatctatgaatgaattgaccctgaaatggagtagcacgttttcagttgtgagttgagttctgaacatgccgtaaggatttgtgtgagatctataggagaaaatttctttacagatggagataatctatatatgatcgagcggcaaatgcaaaaaaattcgaaccgcccaaatttgaaaaatagtccgaacccctgttggttcacgtgaaccgttggatgaagcacgtgcggacgagatgtacgaggagtggttgaaggcgatcgatgcgaatggtggtcgcgtggggggtcggagaaaaattccccgaaccccatttaggttcatgtgaaccgtcggatggagatcgtgcggtcaagaaatcgaatactggagctcgatgggtgtacttatgatttgattatcttctgattccgtagccaattagggtaggcggcgccggcgccggcgcgcgcgaggggcggcgaccggcggcgaagcgcctccctccgcgcccccacgacctctgcgccgccagatctggccccgcctccaccgccgcatccaggtacgtccacctccgccggcctctcctcgaactctactctttgctcacacgagtcacgacgccgccgccgggccgccaaatccccccccccccacgagaccccaaggattttggcctccaaatttggcgtgcgcgatgtcgattccgctgcagcgatctatgatatgacgcgcaagttctaggatgaagggcgacacagaagataatagagtttagaattgagaatttacagagaaaaaaaaattagagttgtcaaaacggaataatttacaacaagactatagacccccccaggcaacttaattactatatcatattctgaatactttatgccatctgaaacctgtttgaaagatatcaatgtatgctttactctactgttacacttgagactactaaaatcattgctggcaaagctaag

SEQ ID NO: 745 - DNA, 14482 bp, Oryza sativa
gctagcattcttacttgcgctgggccgggcgcgtcagcagctgactgctttagttggctagctcttgtgcgtcttgcaatggatttgctttactactggactactagaggagaggatgaacttcgagtgtgctgtgctgtgctgtggtgatagatagcatacatgcatatgcagcatatggacatatggtgggggtactccgaatatatttctggattgtggttggttcttttgctactgcttgccttttctgactcgctctctctctctctctctatatatatatatatatatatatatatggagtatatagcttttttttcctactagtgagagagagagagagaagccattattatttttcccggaagaacaagaggaaacgaataaaaaggaaatctacatcaataaagctaattcacagttccttgtgctatacaaacgtacagtagattattgattagcaacagattctcactggattatatcgtgaaaattagaaatatgtactgctggtggttctgtgtttcctctgtttgagctgacaatacgtctgctatactacacggggttagtttcttataatctctgaatagtagtatgtcaactgtagtttttgttttcctttctagagattattttcctgtttacgacacataaataaagttaataatttgcggggggcgataataattgaattaattaaataaatagaataattatgcttggagtgttttgaggagaaatgatactagggatttggagaagagaatgagattctttgtttggacgggtggcccagcattgacgggagatgggccggataggcccagaaaaagagcccaaagaaagaaggaggtggacacgtgggagatctgcgcggatctcggggagcgcaagggagcgcgcggcttttgatttcgtgggatctcaggggcgggcccaccagcggcgctccccacttccatttgttccacgtcaccgccctccccaatatctagtagcagtagcagcggagggagcggcacacgatacgcgccgcgcggatcccctcccttccctcctcttcttcctccgccttcgccgccgccgccgccgccgccgattactcgcttccgcctccgcctcaaccccgttcgtccccaaccaaccaaccgcaggtaacttcccctctggatcttccacagtatgtattcgtcgattcatttcattttcatccgggttcatcagtccaatccaagcgaatactaagctcacttgaattcggttggtgcctcgtcgtcattctgccaccacttgagagttccttcatacacacaccactcgcagtctcagcagcagcagcagcagcgcaggtaatttcactttacagtttcttctactactatcatagtcctagtcctagtactatactactataatactatgtgtctgatgcaactctctctagtccgtagcaaagctgctgttatcttcctacgtacgtaagctggatcatatccttctctttttttttctctatctctattctttctcatttgtgagattgatttgcacaactgcacaagcacagatgcggatgcagcccagctagctaagctaggttagctgctgctgttggtcttggaggcaaactagtgtaatatgtgccgtaccgcctgcctttcttcatcaaccaaacccctgccaccactcaacccggccaacctcttcgagtcaggctgatgatgggaaccgctcatcacaaccaaaccgccggctctgccctcggagtcggagtcggagatgccaacgacgccgtgcctggggctgggggtgggggctacagcgacccggatggcggaccaatctccggtgtgcagcggccaccgcaggtctgctgggagcgcttcatccagaagaagactatcaaagtcttgctagttgatagcgatgactccaccaggcaggtggtcagtgccctgcttcgtcactgcatgtatgaaggtctgtctcttctttcctccttctaccttctcacttctgtctatttatttatatgtttgcctttttcacaacatattttcctattattacttactatctgactctcaaactgttaatttttctgctcctcatctctgtttaatcacacgtaccgcctctgctttacaatttgctgtagtgattttatccggaaactatcttcttaaggattgtaccaaacacatttttcaccacaaattagacgattgtcaagttcagaacaagattttgaacacctacatcacaaggacgataagcaagcaacaagatcatttggtacataaatctgttgaatactttgttttgaaacataaagtatgctgttccaaagtcttgtttgagagactgacttgaaccctgcaaaatccatgcacactttgtcatgctagccgctaaagccaaatttaaactaggcctgattaggtcaactggaaactccttctgatttttttttgttgaaaaaaggggtgcagattgtggtactgataatcatctcaaggtcctcctttttttttctactgaaatcatgtcaaggtccttgaacggacacgttaccaaatcaatttgttgaagaagggagagataactttttaatccaagattaatctccacgttgtatgagaggccaccttgaattgatggtttctaatgattttgggttttcttttttatttcaatacttgtatgaatttctagtgccaatattttggaccaatgctcttgtattccttatctttaatttggatgcaacttttccattggatacatcaaacgagaatgaagtcatagggatagtttgttgttgttgtgttgtgttggatacctccttttggcacccagttcaccttcttcttgtaagccaatgggtaccacctagaatctccagccatctgtggacagcactatatattgcaggcttgttttcttcaaagtatttttatgccttccctgtcttcgtatcatattgatgtatgattttggactggaaaatgatttgattctatttcgatcgctagcctactgttaggtttgtcctattctgctgctttggtgtggttgcttcagctcatgaagggggttgctgcggatgggcacatcaaaaccatttctttttcattccattggtagcatcacttctggggagcgaccatcaaatgctacgtagacaaccataccttgtccttctcccttggttgttggccatgggagaattgttttcattgcctaagccagagggtccttttcatcgcatgttggaaagtccagctatgcagtagcccgaaactcctcttctgccacccaacattgcctccctacaggtgacatgtgccaaatggcgacggcagcaagactagaccacccagcttggcgataggaattggaggttgtcggcctcttcttgtatgtggggtggcagatttactgccaccaccattagagtctgtttaaaagagtatatatacttggacatcaaaaagcacatgctagattacatgaaagtaggaaaagtctaggtagctcaatgaaggttttgttataacatggtcaagtaagggtgtagggcctgattacagggcactcccaatttgattgatgagtacttctacagtgctctctgaatactacaagtattgttaccaatagaagcgatagaagtcagtgatttatgagttctactaccactagaaaaaaaatttctgctaccagtagttgaggtggtagcataaatagatatggcccattggatgagaaaagatgacaggactagattgattttactaccagtaaaaaccaccgaataaagtttctaactattctttcctcacactattgagaagaaggcacttccattaaaaaggaaaacattttcgatatcaaggcatcaatttgtttttcattaaaaaggaaactgaatgaggggataaaaaccttccgttgggctttgcatgcgaatagtctaataaatactccctctgttttcttttatttgacacctttgactccacacacaaaactaggcaatcattgtactttctagagatgactattttactcttagagaaatttagtgttgttggtagggtatgctcacacaagaactttctagattagtgtggatgaatacatagttgtttcttataagggcaaaatgggaaaataaagattgagtttcgtgccgtgccaattatttgcaaacaactttggtcaaagttgtctaattaaaagagaactgagggagtaaagaattctagctcagcctaggaaagtagagccaacaacataagtcaatgagtccatgttgcttttgagccaactaattgagcaacaagtttggcatctactacaaaagagagaataaccatgtgagaagggtatatcatttagtaggaagggtatatcctggaatacctcgcttgacctctttcaaatgattgtcttggcttggcttcggtttagctggcacatttattaggaggaagggtttcttggagcttttcttcattgcttgctggcacatttggaaacagcgtaatgaaaagatttttcagcatattgatccttctttgatgcctggtggtctgcctttcagacatgagattctcctatataactataggatgaatggcccctacgacaaatagttgttgattggttactacttttgtagttctttggtttttgtttttgccttttatgtacatattcctataaaacttttttgttctctgacatggggtagttcttcccctaaaacaaacactcaattcaccggtctgacctgtggaccggctggttgaatcatggttcaatagcgtatatatacattgtatattctctgtagatcacaagggaagaatgacaggaatggtaggctaaagctcagagttctcagtgcacggacctgagttcaagtccccatgccacaaccttttctaggatttttattaaaaaaacagaaggcataaattgggccttgatgtggcccatttatctctgcacggttcaaccggggcagtttaatgtccaatttagcttaaactaggccggtccgcccagtccaatccagctcaaatgcatgttcggtctttgagtgcaaccgtggcgaccttttgttctgtttttttaggtcgacttgttgacccggttcagtttttttacactatgacgcctggagatacaactgctgggctaaaatgggttgagcaactgtcgagttggcctgagcaaaggaagggcccacacaactctgcccatgtttctggaaagagaatcatcgctccgattcttctctcttctaggctagtttgagcaattcccaggtcagctcataacaatgtgatatcagagctcgtcaatcctagagaagtcgtgattccgaacacgtatgcagcaacaggtcgaggatatggattttaggaaagtattccaaacacataagtgtgggcctttccttgctcggcccaacccatcggttgcttgacccatttcatcagttgacccaagaattgtatttctaggtgtatgtgggtccgctatacgtgagagtgaaatctagattttggaggcaccgaggcagggtgtgatatcaagattgtaatcctactcatgagtaatacaatgaacatatcttgattgttttaaaaaaaccgacaaggctgtgatgttcttttcacaaaaagaaagaaagaaaagaagacgccaatgttgtgctggtcttttggcctgtaatggctctttatggacgagaacattgttattaagctattgttgctggtgacttgtctagaacacactacacatacactctcctcggaaatttcattagccacaagtgttagcacctccaacctaatcccatcctgaaggacctagaacttgattttatccattatctaaaaagaaaggacctagaacttgccttcccacagaaaggaattacgagggtcttgtcatgttgctagccgatgataatatctgccaaatattcttgaagtgcaggaagttacccttgtaagcatcgaagaaacaggatcctaagtgcctcgcaagcttgtgcacaacatgacccaatggttggaatagtggcaaacaccggactaaaatttagtatagactagtccactggtttgacatatgcttgttctcagtctgactatattggggagtaaaggttttttttttcatatttcaacattagaaactttaaattgttggtctagtactcatacttggctgtgttcgcatatgtgggttgggaactcattccctccgcatggaaaacggagtggtccattagcacgtgattaattaagtattagctatttttttcaaaaatggattaatttgatttttttaagcaactttcgtatagaaactttttacaaaaacataccgtttagcaatttgaaaagcgtgcatgtggaaaacgagggagaagggttgggaaaaggggatgccgaacacagccttaagtttgttggtcgcactgtacccaagcatgtggagctttgatttccttcagtctgtacaattttgggtgagatatgcacaacagcacaagataaatatagcgtgttctaatattttaactcacccgctaatttacccagctgccaatatttttcatgattgacgtagcctgtacaaattcgatccttattttttgtaatttgttatggactagctagggtaagggtttgaatacaaggtgctccgtgggaaccattaatggcatcagatggacctttttatactggagtttgaatgtttggggaatagacaagagacttatgcatcattttattgagaaggaaagggtctggtataaatccaaaaaatgaaaaacaaaacaacaaagaaactagaaatgtcaaatgtggtgggtggtggtgaataatgctgcttgctagcgggagatgcctgcccattggctatctctcgcaaaatgatagtgtgaccaagaaaagataaagcactctatgccttgagctgtgggatcatcactccagtccagcagcacttgatcctttttttctcattgcaggcattatattcaatttgctaacgactttaactgagatcactgatttatggtccccattctttgactaaaactcatttctgcattgtgcacttgcttgctgtttcaagtattattcatatttcttgtggatcttccattcgattatactcttgtttattcggcttctttgttaaggacagggagccaagcacactagagtaatattctgaatgcagactggcttttgtgacctttgtcggccccggttttgggtgcttcttcttagttgcaatacctcggggaagttctttccccttggggccaaggtttttttttaatgcacaagatattttatctttgttggtctttgactgagtgttattaatttatttctgtgaagtcatccctgctgaaaatggccagcaagcatggacatatctagaagatatgcaaaacagcattgatcttgttttgacagaggttgttatgcctggtgtatctggaatttctctattgagtaggatcatgaaccacaatatttgcaagaatattccagtgattagtaagtagctttcctcaactctacagtacaattcttgtacaaaatgttgcccttgtcatttatttactttctatgcttttagctgctacactgttgtggtttatgtgcagtgatgtcttcaaatgatgctatgggtacagtttttaagtgtttgtcaaagggcgctgttgacttcttagtcaagcccatacgtaagaatgaacttaagaacctatggcagcatgtgtggagacggtgccacagcgtaagttgttgttggtccagtttttcttatatattagatgttcaggcaaatccatcaagtactgactgctgcttcaccattttatggttacaatatgtgatgactctaaactaaagttgttattttcaaattcagtccagtggcagtggaagtgaaagtggcattcagacacaaaagtgtgccaaatcaaaaagtggggatgaatccaataataacaatggcagcaatgacgatgatgacgacgatggtgtaatcatgggacttaatgcaagagatggcagtgataacggcagtggcactcaagtatgaaacttgatctttttattccaacatagctttactactacctgttaacaaagctgtaattagaatgagaagaaaaaactgaagttaaaaactgaataaacctgtcagtaacaatgatttctgaaggcataaatgacatttttttgcatagctgataaatttattttagaatagtgggaaataggaagagttcaccatgtcactgtaaagtttttgaattaaccaaaccagtaaaataccatggatcatctgcatataacaatcttaatattgtacaaacacaacagatgaaacacatactgaagaaaatatagttatcgcctctcggatagtttacatgtgtgttcatgtggcactatcgttttgcttaactaataccaaggtgccaaataaaccagcggttggttcattgcattttggagcacatatagtatttataaatcttgatagcgtgtgtgtagaatgttccaccagaagttgatagcactgtgctttttgcatgttcaaggaatcaaatggattgtacaatacatgcaaccaaactttgatgtagggaatttctttgttttggcttggatgtccaacttatagtttctcaccagttggattaacttcttttccttgttctcccattgtaaacgtgaattgaacaatccttgccttttaagataaatgtggggtctatgctttatgctgccctttaaatttttgaaatgctaataagtagtttgcatgcatcgtgcttctctaaatgtcatcaagttgactaatatacagttcactatcaatcagctaataccactttattttatgtgtttcctattataaattgaacattttgtttccttaccaactagaaatcatagtacagatacatattgtatagttattttcggtttattcatgaatttgtgttagaattagactatatagacattgctggttaaaaagtactcatcccctaacactgtgggaagagtacaaaactactagtgtgttaacaccattggcctcttgacattcaaaactgctacccaatgaacacattccccatcaatggtccaataatcccgaagtctaaagtccttaatcaactcgtgcataattattcacttggtaaggaaataggaaaaggatggatgcacacaaatgttttgtccatttttgctaagcctccagtatttttacttctgtgttttgagcttcataatggtttccatgtcttttcttcaattaacgcttttgtcctgtattttgatttctatttgcaccatttaatgaatcttccaaatttgggtttttcctcttgatgatttttaacttcacatctcaattgatctttaaaatatgcctaattatttaatactacctccgtcccaaaatatagcaacctaagactggataggacatatcctagtccaatgaatctggacaacccttgtccagattccttggactaggatatgttccatccaatcctaaattgctatattttgggatggagagagtatcatctaattaattacctgcaaatctgcaatgctctgcttaaacatattgtatattttctatactaatttactatacttattatcaaaatgaaacgtatattaaaaattaaatatctgctgcaatatgtgccctcaaaactagtataaacatattgtatattttcttttcaaagttacctttaatttggcgacatgtttggattgataaaatcaagtctaagcttgcaaatttggttctcctgatgctgtatgtttgattccactaaatagattctcttcaatgacctaggcaagctgtcgtagtttatcccaaatgtgttgaaaaggttgttctgggtatcaccgtacagatagattgatcctgaaattcgtatgcagagtaaacaaaatagtcttatcaacatagataatgctaaacatcatatcatcagcgcactagtgcaggactgccttgacatataatggttgcctgaaatggcaatgaaataaaaaatcttttatttaaaaagcaagattcaattgtgaattagcaatagttggagaaatttagagttacaggatatggcacacgaggtgtacttgagaactgtcggtttgtagctagagatggctacgaatgccgccggggggtacctagcttatcggcggtggatgaaaactagtgtaaacttgaaattagtccacgtttcatgtggatgaaatctagtgtaaacttgaaattagtccacgtttattatgaaacgttgactacagaccctaccgagataaactgtatcttatgtgttgctgtcaagttctcttttattacagtgttgtggagtggggtaaaatttttttcctgtcagttagttatgaatcacataagattttgccactgaaatgttcagtgacatggccgatatgtcaatgtaagaaacaacttagaataaattccacattacaatattcagaaataattactgtagatcggatcactttgtgaagtgcatttaaactggttgctcatcatttttttaaggcgcagagctcatggacaaagcgcgctgttgagattgacagtccacaggctatgtctccagatcaattagctgatccacctgatagcacttgtgcacaagtgatccacctgaagtcagatatatgcagcaatagatggttaccatgtacaagcaacaaaaattccaagaaacaaaaagaaactaatggtattgtatgctcaactgattcattgtgcaactcgataaaacaaaagctccataacactgtatattaataaatttcaacatgtttttttttcagatgacttcaaggggaaggacttggaaataggttctcctagaaatttaaacacagcttatcaatcctctccgaatgagagatccatcaaaccaacagatagacggaatgaatatccactgcaaaacaattcaaaggaggcagcgatggaaaatctggaggagtcaagtgttcgagctgctgacttaattggttcgatggccaaaaacatggatgcacaacaggcagcaagagccgcaaatgcccctaattgctcctccaaagtgccagaagggaaagataagaaccgtgataatattatgccatcacttgaattaagtttgaaaaggtcaagatcgactggggatggtgcaaacgcaatccaagaggaacaacggaatgttttgagacgatcagatctctcggcatttacgaggtgcaaaacataatatcagtgtcgctagtgagttaggaaaccattgttaagttgcatactaactgttacttttgttgcaaggtaccatacacctgtggcttccaatcaaggtgggacaggattcatgggaagctgttcgctgcatgataatagctcagaggctatgaaaacggattctgcttacaacatgaagtcaaactcagatgctgcaccaataaaacaaggttctaatggtagtagcaataacaatgacatgggttccactacaaagaacgttgtgacaaagcctagtacaaataaggagagagtaatgtcaccctcagctgttaaggctaatggacacacatcagcatttcatcctgcacagcactggacgtctccagctaatacaacaggaaaagaaaagactgatgaagtggctaacaatgcagcaaagagggctcagcctggtgaagtacagagcaacctcgtacaacaccctcgcccaatacttcattatgttcatttcgatgtgtcacgtgagaatggtggatccggggcccctcaatgtggttcatccaatgtatttgatcctcctgtcgaaggtcatgctgccaactatggtgtcaatggaagcaactcaggcagtaacaatggaagcaatgggcagaatgggagtacgactgctgtaaatgctgaacggccaaatatggagatcgctaatggcaccatcaacaaaagtggacctggaggtggcaatggaagtggaagcggcagtggcaatgacatgtatctgaaacgcttcactcaacgagagcatagagtggctgcagtgatcaagtttagacagaaaaggaaagagcgcaacttcggaaaaaaggtagcctgttttcaattgcatgttttctgttcctttggttttagcattcctgtttaactcgtctaaattagctaaagaacatgttactggaagtagttgtcaaaagcatattactggaagtttctcccaaacgactagctaaatgggatcgggcatgaatataatttgtttatatactagtattatctgatttctaaaaggaatctcacaagataatcttccaaaaagttgcacgtttttggtcccatagccgtgttgctgaaatttcttgccaatgacatttcttggatttttctcataatttaatggtagctacttagagcggcaattcaattttactcttgaaacactgtcctttacttttcggcgcgggtgagtacaatttggataggaggctctttttatatatagagaaacatacatacatacatacatatatatatatatatatatatatatatatatgatgtgcttgattaagctttggataggatcggtttctttctgatggctgtctgccattttcaggtgcggtaccagagcagaaagaggctggccgagcagcggccaagggtccgcggacagttcgtgcggcaagctgtgcaagaccaacaacagcagggtggtgggcgcgaagcggcagcggacagatgacctacctacctacctacgcgatggctttggactccaaacagctaattaacagttagtagacaacagataatgattcttcttccttggccgatcgatcaacaacatcccatgcatccggcatcccaccaccattgattccatcatatttagagtctggaataaataaggaactcctatcctatttatcccctatctatatatgaagatatgataatggtgatctgcgttactactagtagaagaatatggtgtggctgactccacttcaggtggacctataatactactccagtagtatgtgcctgtggagtcaagctcgaacgtactactccatatttaagcatgtcatgtactgctactatgagacgagagtgctctgccctgtagggacagcactattgtcaatgtcatgtgtttgttgggtcactggtcttcttagatttgcgtccatgtctggcagcagcactccactgtagttggctcacgcatgttgttgaaatgagccacatgccttgccttgagatagaacttgctgtcactgtttctccttaatctaaatatactggagtggagtattttattatctatgatctgtaatcaggtgattgacaaggctcgtcaaatttctatgcctttggtaggagagtatcacgtacttttttttacgactcgtacgagacggtaaaaagaaatacaaaaggttgtaactaataaaaaaacgaaaaattacaccaccatccacacaccgacggcgccaacacataggttcggaagaagtctagcaccggaccggctgtcgctaagcgtgatcgaccgctgctgagccaacaacggaacatagacgagatcgccgaaaaaacacccttacaaccaacacaaggcctaactctacccacgtcttttagatttagggagagaaggtgagagagatgaaacacccctcccccctaggcccttcgacgtggtcaacttgtagaaactaggatgccatcataagagaatgagaatttagagcgtgcttgcaccaattgcacacgtgttttcagcaagagaatgcttagatgacatctccaaggagagaagcgacggaaaaccgccgccgccgtccgtcaaggtctcaaaaagagcaaagacagggctttcgcccttcaaccatccttgaggggtgagatggcacgacaacaccctcaggagggggaatgacactcgagcgccatcattgtcggtccggccaaggctaggttgggttttcacccaccgctcaccacctacgagtccatggctgacgtaccgatgctccaccactgcccaatctctactgacatgtgggaccaatgccccggcgcctcccgccggccaacctttgtgcaatgtagaccgtgccacatccaccggtagctcttccttgcaccgtggtcgcgtcctccaccgccggccgcgtatcacgtattgattgtatcttatctagtactactggattatagtagtattatgggacggagggagagtatcctgtttacggtaggttttgtccggctgcaaagaaaacggaaagctcctttattacgaccgagatggccattctct

SEQ ID NO: 746 - DNA, 4664 bp, Oryza sativa; identical to SEQ ID NO: 227

SEQ ID NO: 747 - DNA, 3704 bp, Oryza sativa
ggaaatgaatccagttgagaaagagcaataattttaaacactaaacaacaggtaattacggcagtggcttcctctggaatctgacaaatggcacgatctcagttgtttatatgaagctccggttgctaactactaaaactaatcacccgtttaccattcaaacctcccaaagcatataattgatttcctaatccagaagcctgcagctgatgaagtagtggaaattaaaacctagtaatttcaaccttaagcttctgaggttatgttaattaatccgcgtactctacccaagttgttatcacatatattcttctattattgtgcgatgtgatggcgcgaataatccatagaactttgaagccaaaaaaagagtggaaaaggggataagagaagcatctcacacaaggcccctttgccctttgtcctgccttttccttttatgaaaatgcacaagataccatattccatcacaagtgaagtgagagcagagatatttttctttttcatgtcacaattttcacaatgtaatatatgcactcgcagatgccatctttagcaatgagcttacaatatgcattatcttttttattatcaagcaaaactatatgagatgtaagtgtgtgaccccctttttttgggtagaaagattgcagtgcatcaatgccactaatgtgatgccttgccattggcctaggaaccccaagaaatcaaaaatctttgtagatagcaatttttttcttgaggtgacatggctagctagtggtggtcatccaggctgtggactgtgccatgatatcctttggaatattttctggtttcccctgtcttgatctttttggaactctggtctcatgttcttcaacatgatattcgagcccgtcagcaatggcaactagtcccccccctctctctctctctctctcatcgacctccatctccccacctccatttcatctctagctatacaccatactttcatgcacaattatacatatctcaattctcataaaataaatcaatcccttgcctagactccaataacaaaagaaaatgtaatacttccttcggtcattagtatatgttagtataaattaaataattaaacaccttaaacaatattttttcgtcgtagtttgatcatcacctaagattttttagtcttttcaaaatgatcatcagctaacaagtgtatctttatttatttgtgcaagaagtaaatgagcatcattgaatgcgctgcacacatgtaatgcaaacaaccaagttaatttttattggtgcaacggcgcgcactatttaaaacgtgacgcaatgcagcgatagagcaccttgatagataagaattaatttcagcatgatgtagattttgttatccttaatctctactcactttgcataggtaataaattaaaccgctgaactattactacatggtttacatgaaaggtgatcgggtagggacgagaatgtcgcgacacacataatatatatagtagcgtccttatgtttgctttgtgtccgcatcgataccgtcttcccactcgcatctcctcacctcctttccttctttaaaaggagagcatcaccactccatcctcaactcccataacctcccccttctctctctctctaactacacactctctctctagctagctagctagctatagctagtgttgttagcttcacatgaagagtaggaagagctatgggcacttgctgagcccggtgggcagcccgccgttggacaacgagtccggcgaggcggcggcggcggctgcggctggcggcggcggctgcgggagcagcgccgggtatgtcgtctacggcggcggcggcggtggggactcgccggcgaaggagcaggacaggttcctgccgatcgcgaacgtgagccgcatcatgaagcggtcgctgccggcgaacgccaagatctccaaggagtcgaaggagacggtgcaggagtgcgtgtcggagttcatcagcttcgttacaggcgaggcctccgacaagtgccagcgcgagaagcggaagaccatcaacggcgacgacctcctctgggccatgaccacgctggggttcgaggcctacgtcggcccgctcaagtcctacctcaaccgctaccgcgaggccgagggcgagaaggccgacgtgctcggcggcgccggcggcgccgccgcggcgcgccacggcgagggcggttgctgcggcggcggcggcggcggcgccgatggcgtcgtcatcgacgggcattacccgctcgccggcggcctgtcacactcacaccatggtcatcagcagcaggacggcggcggcgacgtcgggctcatgatgggcggcggcgacgccggcgtcgggtacaacgccggggccgggtcgacgacgacggcgttctacgcgccggcggcgacggcggcgtcagggaacaaggcgtactgcggcggcgacgggtcgagggtgatggagttcgagggcatcggcggcgaggaggagagcggaggcggcggcggcggcggcgagagggggttcgccggccacctccatggcgtgcaatggtttagactaaagaggaatactaattagctagctaggcacacgcgtagttttattattacttaattaccgcgttaattaattgttgatgctgatgctgtttaaaattgattctccttttgcatgaaatgtttgatggtatggtttaaaattgaagaaaaatagtccttgaaatttctgtaggagttcggttgtgatccaaatccaatcagatatgtgtagtttggcccatggcggctcacgctcatctgggcttggcacattggggaaaacatatatttaaacatatactttttgaagtgtgaatcaaataatctatttcaatagtatgataaataagctaaaaagaacatgtggctaacaacattcgcacggtaatttttcgtttcaattagacggaagacttctagtcacctgttgttattttagggaaaatttaattttttttccactataaattttctcaattatctaaatgttctttctagatttgctatttttttattactcttaagaggtggtttctgaactattttccttttttctcaagtggcatgccaacatggcaatatagggtgaaaatggtgtgggaccgataattgcaattttgattcaaattttcggacccccagcaagtcattacatcgacataaattttcgggttttcttaatttcttttgttcaatttgataataatttatttaaattcagtcaaaatttgttaaaattttaaataatttcggttcaaaagtgctgaaaaccaagaagtttgtaaatttcggtgctaccgaaattttcaccaaaaacgaaactgcaaaccatgtgtaggacgcactggtcagtgtctctccctccgctggccttctctctcactgccgctgccgtggctaggccctctttgctgccatcgccgtgagggtgagcatgagggtgggtgtctaccacccgacagctgccctggtgttcgaccgcctcctcgttggcggcttgcacgatgataatggcagcatgagttacatcgtcggtgtccacctttccctcattgtcgcgctctacacggcctggaggatgctgttgtactgccctttttcactaccgtcgctccggctccacgcatgaaccagcggcgtggcagctgccaacgatgctgt

SEQ ID NO: 748 - DNA, 7648 bp, Oryza sativa
tatgccataagagcgaacgtggaggctcctttttctattcttttaataatataatagatgtagaagatcaaaacctcattgaactatatattagcttattcgtttggcctattgctggcttattagtaaaaaaacaatttatggttaagattattagtgctctgttacgtatcaaacctatccctacccacactattggcctggccttagtgccagaacctgtttatttcttctgttttatagtctgatgcatttttgttaatggaaatggagggcctttttcccttcgataaaaaaaatgtataagattattagttaattatggtagtattgaaaaatataccacgataaaaaaacttaaaatcaaattaaaattaagtttcaacatttatattttagctacgggtgataagtcaaaacacaaacaacggtctttgtacgtaagtctttttcaaaacttgtggtaaacattctccgttcagttattaatatttgatgtttaggacaagatccgatcaaacttctaaaattctaacaaatcaattctatattaaattaagtttatgaagcgctataagcttgtgattttatgatagcacttgttgagataaatatatgtatatcttttatcttatctttaaactaagtagaggtatttgttaaattattgatgatcagaaatttaaaaagttcgaccatatcttgtactagtactaaacgtaaaatatttttgactaaaggaagtaattaaaatttaagaggcaaaattacgtgtgaatttgagaagacttccaattcaacagctcaatgatcgggacacattcttaaaaaagaaaaaaaagaaacaaaaaagatccggacacgcatgcgcaaatggagctttcataggcagaaggcgtaatcaactggaaggcgtcttctcctggagggaaaggtcgggcccacgtaagggaacaaaaccacctgtcagtgaccaaaagccagcagattccagagtcgccgtcccacgccgcctctatctatctccacgtgaaataaaaaaaaaacaaagctcccgaaaatattctctctcccccacccccgaaaccctagcgcgacctcgccgccggcaatggccgcatgaccgatgcgcctccgccgaggagccgcccgcacccacccagcagcagcgtcgccgtgcccgccgccgcggcggcagtgatcgcagccgccctcgcgtcctccttcctcgccctgctgcagccgccccggcgcgccccggtcgccgcgggatccagggtcggcatgtcgaaggcgagggtctacgccgacgtcaacgtgctgcgccccaaggagtactgggactacgaggcgctcaccgttcaatgggggtaggtagcacagccagccagctgacgtcaccttcctgagccccctgatcagcggccgtagcttgtattctccagatttagttcgcgatccgtatcccgtacacctgggctgggtttgcttattgggattaggttggattattgggttatgcgtaggtttgcttgtgcctgtagattttggttttggtcagggaattgggaatttattgtagcttgaaggttagattgaattgcttctgtttctattaggacgaactcaataccgaagactgctttggtagttttacatgtttgtactataggagtaggggacacatgtttaccgaatggttgaagaaattgttatgaatttgcaaggttatgattttaattttggaatcaatctcactatatcttccttttaaagttgatactagtgttgttcagttaagagcctttgtttgattgtgaatggcaagctgtaggtattgatcctatttttgttggggataaaatctaagttaaggcaaaattaggcagttttatgtttaatcattggaacaaagtaagttggtgatgggtttctgggtgtttcttttgcatcatctgataaccaagattgatgagtaaagcataacttggtagtatagtgctttgggcctaatcttctttagcactgaacattcaccaagttctatgcttttatgtaatctcaaatttaacattgtgttttccttcactcaccctagaatatactacctgaaagcaatcaatgaaatcaaatataacttcgtttctacctatatgattgtaacatgctgagtaatatggtgccaaacaactcaacacatataatactgtccttaacaacccatcttcttttccctgtagaagttacagccctagtatattctgtacatgtcatgctacctagatgacagttgaggcctggtaggagtgtgcttgtttaattttggtactccaaaagtgcactgtttttctcaatctgactctgttaccagttgtgtttcctctagatgtattccttatctatggtgaattattaaataagttgtctggtgacaaaaaaaaaagaaaaataaaagaagagatgaacaatatgtagctcattgatgatcccttgtctgcttgaactttatgagaaactatagaaagcagtggtgttttccctgacctgatgttaaatacttgttaagaattgagctttcttcgaagtttgttcagtttacacaccaacactaagaattgccatatatctcccatcttttgtccatttaattcttgttacctcaagtcattgagggacctggcagcatgttatgacttacacaatacctcgctaactattatggtgcatctttaacagtgagcaggatgactatgaagttgtcaggaaagttggaagaggtaaatatagtgaagtctttgaaggcatcaatgttaacaacaatgagaaatgcatcatcaagatactcaagcctgtgaagaaaaagaaggtatttaattgatcttattgactgttttttttaattgctagtgttgaagttcttaacctacctttcatatgtttgaacagatcaaaagggagattaaaatacttcagaatctttgtggaggtccaaacattgtgtagcttcttgatattgtcagagatcaacattctaagactcctagcttgatctttgaatatgtcaacaatacagacttcaaagtgctgtaccccacgttgacagattatgatatccgctactacatatatgagctactcaaggtcttcattgagccttcattgtcatccctatttatttactctattcagtaaaacatcctgttctgtggatctgtagaatgatgtatctcttatagaaattgtttcacaattactttcctattatgtgaagatccaactaaacacacttgtaatatatcctagacaaatatcaccattctcactgcttgcaagttgcaacatatctttaattatttatgtatatatgaacttgattattttctaagttacatggcttaaaacttgtcacaatctcaagcagtttatggatcagttttgttttgagttttaattatagtagcatcttgcacttcataatgtacagatgacaaaagaattcctgaattgcatatgtgctataatggtttatgatctgggattttgaagagaagtgtcgttttatacatttctaagttcagcactatgttggtgttaagaattcagccatcaatgggcatcttaacgtatgtgctaggtcatgccttctatccatgggtaataaactgttaacacacagtgtgtgtttttcatatcgatattcttagccaagaacagtagcatcatttgcccttaatcctgtgtgttaagtttgtttaaagaatctagttgattttctttacaatattttccttctgtttatggccccaggcattagactactgccattcacaaggcattatgcatcgagatgtcaagccccacaatgttatgatagatcatgagctccgaaaacttcgattgatagactggggcctggctgagttctatcatccagggaaggaatataatgttcgtgttgcttcaaggttggtgtagttacaagcaaactacttgtttggttatgattttcttgcttttttattgaattggattgcaccctgataatcacttgaatcatgagaggaagctaacttaagaaggtagcatccctgttttgcagtttgtttgctaacttggctctagaagcaatacgtgaaccgataaattacttggtttgaattcactgctactgttgaagtctgaattgcctagtggtccttttgcaacattaatgttacgaaatgctgaaagttaagcaatgaagctgtttacccttaaacaactaagtttacgtctgaaaaaaaggcaataaaacagataccattactagccctttattatttttgtaagcatgttatcactggagtatatcatgcaattattgggtgtacgtctgaaaaaaggcaataaaacagataccattactaggactttattatttttgtaagcatgttatcactggaatagatcatgcaattattgcttactaatgcgtcaattctttgctcatttttgctttggtacctgagttgagcatatggtttctcgtttttattcaggtatttcaaggggcctgagcttcttgttgatttgcaagattatgattattctttggacatgtggagccttggttgcatgtttgctgggatggtatgtgtggctgtaaaaaatatcgcctgtctaggtcaatgtctggatatctaatgtactattgtattgataataagtctgacgtctgaactcagttaactgtatgctatgatgcagatattccgcaaggagccattcttctatggtcatgataaccatgatcaacttgtcaagatcgcaaaggtaagtcccagtttgattctggcctctcacatttctcaagggaaaaaaaatggtttggtatgcctgataaaatgtttagttatgcaactcgtgttttggactggttggtatacatgttttactttgtttctaaaaaaaattgctgtttgtgctccttttagcttagtactcatatgttattctgacatataagcagtgtgatgtcgtcaaaataaattatgttcatttgtaaattgtgatttttgaagttcttatttgttgctctcgaactcttactaggacggttattggcatttaaagatgttttaagcatccaataatgcctcgagtgtgtgtcagcagtgttgattcgcttgtcatcagttgaaaactaagtacttttccagcattatgctattgatatcggactaaggcagatgtcataatgtactttgatatctatgcaaattttattcttgatctgttttagtggtttatataagtgcttattttggaataacaataaaacagctatatgtgaaatattggtatctgatccatgtgttttccccatcattctcaggtacttggaacagaagcactaaatgcttatttgaacaagtaccatattgagcttgatcctcagcttgaagctcttgttgggaggtacgttgccatgcttttagatattggttttgaacgggaagattcagaagtataacacttacatatacatatgcaggcatagtagaaaaccatggtcgaaattcattaatgctgataaccaacatctagtatctcctgaggtttgtcaatggctcttgctgtttccaaatcaaccttaagataatgtttgcttaacatcatgcttgtacatttgtaggctgtagattttcttgataagcttctacgttatgatcaccaagataggctcactgcacgtgaagctatggtaagtctaccccgacagataatatttgttacattccaagaagatactgattttgtttgactggatatttcctatttatgtaacagtattgactgttcactgagattgttagtttattgctgaatattttagtatatatcctcctttttagtcataagaattacatcaatgatgtcataatagtactttcatcttcctatcctatcacacctctgttcaatttttattttaggcatattctgtttcacttattgctctgtattatgacaatatcataaaacattttcctgaccctcaaccaaaaatagttggcaagttatgcatttgtataggtacacttcaactagggatgcaagtggagcgggcaatcggttattttttgcctgtttatctcaattctagttcaattgttgtaggtatttatgcaggtaacaggattgcttactcgcatcgctaacttcaacccaatataatttggcaaatggtgcatttggcaatagatagaaacccttcaaatttctctgccacattggcttttgtatgcaatgaacaacgtttcatcttcacatagtatctggccagttgtaggaggaacaaattgttatttgattactcttggacttctcaaattaatgccataatcatgaatacttgcaggcacatccgtacttcctccaagtgagagctgcagaaaatagcagagcacgaccacaatgatcttgtgtacctgctaaaatgatgatccagctgatgatccacgacggtactactttgagtttgtgtgaacgatcgtggaatgtgcttgtagccttgcatttgtaaactgtaattcactccgttggttgcgtttgatgaatgccgtgacatgcacataattatttatttctgtaatgttttaccataacaacgattaagatgcaacaggtacctgtatgacagcatgagccttgttaagcttgtttcgaaatgaggccgaagtgcatgtcttagctcggttcaaattactaaaattaactctagtagtaaatattggggccaaaatttggctgcttatttcaccactaacttatttggacctttaacgggccattaaatatacaaaccgaccattcatggcacaggtaggcctcaaatgggcccataaataggcctaccatgagatataatcaggccttacatgggccatcggttggataagcggggcctaaatggaccaaaccatggattctcggggcgtaaatgcagcatccaaaattgggcggtgaaggtaccgtgttctctctccctgttcttttaagggttgaaccgtgttataactcacagaaggaaaaatatcacgaaatatttcgtcctcatgttatgtcacaaattccgtgtgcaaatcccagtacttgtactaatgaaattaaatttttggtcggagggaaaaattaatacgtttgttttcctcaaatgttaatactcatgtgttttgaccgaatgttatataagtcacgaaattataccccgaaggcaaaatatcgcaaaatatttttccctcgtgttactggccataaatttcatgcataatgatcccattgctaatactagtgaaatctgaaatcttgtgtcggagtaaaaaaaataatgtttttcttaaagcttattgctcacaggttttggtagaaggttataacttataaattatagccttacggtaaaaaacacaaaatgtcagaaaaaaaatgatgcgttttttaaaggttcacggattttgatcgaaggtcctcttaatattttacttattgtgatgcattgtaccatagtccatagatctcagaatgcatttactacatgaaatcctttcttctccatttattttcttccagagaggacaaaaattggaccactagaaagccatctcat

SEQ ID NO: 749 - DNA, 18605 bp, Oryza sativa
cgaaaagaataaataattacttaaattttttaaataggatgaatggtcaaacacgtacttaaaaagtcaacggtatcaaatattttaaaacggaggaagtagttaacatataagtaagccacgtcaacccactaagcactgtcaacacgcatagtacatactaaaacttaaaacttaaatgtaactgcatacatcaactacaaattattacattataaaaatcaatatgtaagcatgctaaggcggtatttggtggcacgctaaaccaagcgatggattaacgtataatcaattaagcgtataaaacttaaaaattagactaatataattctttataagtaacttttcaatagaaaacttatgaaaaatgcattgtttagcagttttaaaagcatacgtgcgaaaaacgagaaattagaagttgaaagtggggaaaagaacccaacctaaatcatcattcatcatataattttcacacatttctatcaaattcatcatttatcatattaatttctacattattttaataaatattcagtcatatatatttgctacgagagcctgtgaaaggtcatctgattcaggtaaactttgcacttgtctagaagcggtcgttttatcagctgagcaatatgccaatagccctttatcctatgggacccaagcgagcacgaccgggcctaccaggaaccactcgagagtcgagaccactagatagggatgcaagcggggcggacaagcaggtttttttttttccgcttatttcacttctagttcattttttcttctaaattttatactaccatacgaaaaatagactaacaagcgggtttttatgcgaatagcgggactatccacttgcatccctaccactagataaggtacaagtgctctcaccggctagaaaaccgccacgttttcacctagctgattcgcctgcttcgtctccctgcgcatttgtgcctacttgtcccactcgcatccacgacctcaagaaaccaaaccaaatcaaagcacaacaccacacgccatgctctttgtgtggttcaggtttgcgcatgtccgatcgaaaaacaagtaaagaagccacgtactactattactggaaaaataagaattgaacaattaataggagttgctagctaagctttgccattgctggaaacacgtcttcgcacaggcacccagccatgctgaagttggagccggagttccccggcctgccgcagcggtgcgactcgtgccggtcggcgccgtgcgcgttctattgcctcgccgattcggcggcgctctgtgccacgtgcgacgctgacgtgcactccgtcaacccgctggcacgccgccaccgccgcgtaccaatgggcgtggtggctgcccccggcgccgggggagccttcgtcgtccgccctgcaggcggtgtcaactcctcctggccaatccgagagggcaggaggtgcgactacgacgatgacgacgccgacgccgctggggaggaagacgaagaggcgacgtcgtggcttctgttcgacccgctcaaggactcctcggatcaggggctgccgccgttcggcgacgcgctggtggccgacttcctcaacctcggcgggggcgccggggagaaggaggacgcgtcgtcgagcaaggactgcagcagcagccacgggaagagcagcgagggcagccacgagttcgccgtgcccggcgagcccgtaccggagcgccagggcttcggggcggtgagtatggacattaccgactacgacgcctccaatttcaggcgcgggtacagctttggcgcatcgctcggccacagcgtaagtcttaatgttttttcttacaatcttacacgaattttcatcaatgaattatctacactagtaacttacccgtgctaactatacgataacattaaaccaaagactatcatatgttaacacaatcaaaaatataattagataaatttaaaactcacgtaaagattgaacaatagagagttgttatattttaaagacaaccatgtgcgcaaaatagcatggtaacctttatatcttcactcaaaaccatctattttttgatgcactgagaaattcttataagtaaataaatactatttgctcatgatatgcaaaataactacaagcaactcttattgaaaatttttccatgataattcactgacatattggtcatggatccacatgtcaatgagagaatggaggtcaactttcggagtcaaataaagattttatcccacaatttttggataattaaattatcaaaattacattatcattcataaataaaatgagttgggtaaaaggaaacgagaataccgaacacccatccatccaggtgtgacttcaagagttcaagaccaagaccaacagaaaaatgcattctcaagctcaaaccaaaaagataaagagaaacatagcactactagaaaaataatttttcatagcgttaccctattatttttctggcggttatacgcgaaaaccgcccacaaaaacgtaacaaggggtggggggctacagaccgccagcgaaaatagatttttgtcggcggccgagttaaaatccaccgtccacctattagaatccgctgccgcgaaaaatccacctattccacgcgcttctccaactctctcccttctctctccgcctatctacccaccgttctccctcctttctctgcctctccatccagccgccagcgacgacgaagctcgtggcgcgcgcatcggtcgacgggcggagcactggcggcttggttgacgggcggagcaccggcgactcgcggggcggcggatccggcggaggcgactcgcggggcggcggatccggcggcgacgactcacggggcggtggatccggcggaggcgactcgcggggcggcagatccaacggcggcgactcgcgggggggcgtcgcccagcggcggcgactcgcggggcggcgcggtgcggcgagtccggcgacggtgacaaggagaaggggcgactcgtggggcggcgtcgcccgacgaatccaacggcggcgactagctttgcgaggcggcaggtctgattcgcaccggtggatggcagctcggcgacgaggtgcagtggctgggctctacggcagtgacccacctcctcgtcgaccttgggcctccctgtcgccggcgatggaggatgggcacgccggtgattttgattttttttttcaaaatctggattccaattttcttcttttttaatcaaaaaatattttcactggcgggtgttttatcttccgacagcgaaaaccgaaatttgtgctagcggttgtcttagccagccgccagtgaagacaattttcgctggcggttgtgttaagccggccgccagcaaaaatcgatcttctctaacggtttgtcgctgctagcgtagatgctacatcttaactagcctttactttgtggcggctccgatatccgccagcaaaaacctaaaatggccgccacgaaagattgttttcgtagtagggtagaatacaatctaatgatccatcgcctgctaggctataagttatctattcgcctcttcacttctctttcagcaagcatacttatatggtgaagaaatgagacggtggagttatagattcagcaggaaaaaaaggattcaagagacaaccatactcataatttccataataggaggctcttgttttagccacgacgtacatcatactctgcttcgtcttcactccactttcacgatcctcaccgggctatttgttcatccaccacagcagagcatacctttgatctttcagttttgaaaaataatgttattcatgcatataagtagtaagtggatgattatggatgcttacactggaaatttgaaggactgggtgcttgccgtggtatatctgactggatgtagatgttgccaatatgaccggaggtccacacttgattgcccatgatgatacctaagagagcacggcggactgatcaaatgatcattacctgacatgaaagaaattatctgcacttaagaggaggcacaattcacactgactgattaaagttgttaatcagaggagttgtgttccaaattagaatgattctggtactaacagacgttacaaaattttgcaactctctctgatatcatgttaggactctgtctcaggtcaaaaacaattatgctactcacagattttgtacaaaatttagccctgacttagagttaatactccaattgtgccaaattaaactctaaatcaaattatcattacctaaaaagaaagaaattatttgcataaagaggagacataattcaaacctaactgatcaaagtttccaaccagaggagagtgcttgaatttaaaacaatgccagtactaactcagtgatcatgctctaaaccagaggtctctgtttcaaatcagaacaattctgttactcacagattttgtacaaaaatttagccctaaccaggaagtcccatagcaaacaggagaggttcgctgctttccttggaagtgccatagcaaacctgttacatttatatattctgaattcctcaaaggaattttgaaagcaagctgccagcatgctcaatattaaaaaattcaggttactttaaatgcttatctttatacaattcaaacttttataaaacatagaaaactcccagtttccattgtacaattcaaaaactattaaccatttagtaataaattcacttaaccactcatataagaagcaaagtcaagggacaataacaatgtatatttcagtgttctaaatttcagacggcccaatgcatattaaaaacaactatgccatttttctatttccatttcagcacagaaatatatacttaatataggagtacatagtagaaatacatagatatacatagttagatatggcaggtaccaatcaacaatcatccgataaacatgtagaaatgcactcctaactgcattgtggatgctgctggggaagtcaaccaagcatcaactatggacctttgtaagttcttccgaacaaaagatgcttcgtctgtacgaccataaccgtcaaacacctgtaaaatacccctaaaaatttgaaaccattaaccatctgctgtgaaaactcgtactgaacaaaaaaaaatgatgaacttaacatctcacatatgaatgttacttcagaaatttactgctggtgatgttgggtcccggtttgagcaaagtaatttattcccaaatgttcagtgttataattttattgcctagtttcaagtgctctaaactcacagattgtttacatgcatcaacagaatttgagttggaaattgtcagtgttgaacaaaaaaaaaactaaccttttgattgactggaaatgaaactcttgtgagtctcaatttccctcaatttattgcttctgattaactggaaactgaactctagtgagtgttaaattcccttaattgattgtaccactcaggaagactatctgcctacgtgcagtttgattcccaaatatgttcagaaccatacaaagacctaacccatcaatcctgccaagtctttccaatttcccacaagccctgtattgcatctgcacgccatctcatctaatctcacatcctctcacaaaataacagcaaaatagtccgggcaacagctgctgctgcggctgcttttgttgtgggcactaaaaacaaattggttattttcaagtctaagccattgagggagttgttttggttggtttgctcggtatttcacatgcactattttcgcaaatttgcatttgaactgtaatggttgaaggaacgggatcgagcgatgcttaccttgtccccagcgtggtcgagaggattccggtggtggcttaacagagagcacatggcgcaggatccttggcggcgcgagggagtcggcggtggcgtcgcgacgcagtcggcaagaggggatgccggcggcgtcgatttggaggcgtgtgagggggtgccaacagcgtcaaactggaggcgggaattgatggcgacgcgatgccgggcgtcggcgtcgtcgcacgcgaaggaggggcgtcggaatctatggcgcccggcggctgctgtgatgcggttggtgttgggatacgcgtaggctacgatagcataaatcaaaattttctatcacgtaaaccaggaaccatgcaagtattagatcatagatcgttaccactcgacgcgctgcgcagcggaaggcgctaagaaatcgaaggaattctcgcgaagtagcgcgtgtcgttatagaggaagtagtcgatcgcaccggctcgaccttctcctcgccgtattcccacgccgatcagcatcacaaatcagaggcgcctctaccggtattcacacgtacagggacggaatgccacgcgtagatgtgctagcacccgcgcgcggctagggttttgctcggggaggggagtgacggctagggtttcttacgtgatgcaatacctccgccggttacacccctcacgaatatataggatccatcactcgggcctccaaggcccataggactcctattcggatccctatctgaattaagctcatattagatccccatccaatccctttattccggcccattaagcgtgcgaccctgtaggttcatgtacactcggctgtaacccgaaaactccttttcggtccacgcgtcaacagcggctcctagcagaacgtattgactcaccgggcatacataaagatcatatcggctgaacctctagtgtatacttgtatgaacccctttgcctcacgatatcgattaagctcaaagttagatatgtgctatcctctaatagctcaatcatttactcgaacctgttgatagattatataacttgtgattgactcctcaatcacctttggcatggccatgcacttccataatctacaacatcgaggggcccagagatatctctccataggaggggcaaatcccatcttgattattcatatcccactacatgtttcatagcatacccgaaaactacttttataactacccaattacggagtagcgtttagcagtccctaagtaagctactacacatgttgagaaccatgataattttaagtctaaggattcaacaccaacactaaatgagatcactgatgacacaacatatatggctcttgcagtgtctcatgttgggtctatccaacaacatgttcaccaacatgtgtccacattattaatttggtatctctataccatgatccatgagacatgatcatcaattaatacatgtgttgatcatctaaacatatttgttccacatatgatatttgatcagggatcctttagaaatagcaacacacaacataaagagtctcatgaaagaatcacatattcattaactaataatgagttatctatttcaaggaacaaagtcggataaatatgtaaacatagtatatgatacaatcatctctatgattgcctttagggcatatcactaatagttggagcggcgacgactgttagggttaggcggcggctggcgttgcgtgagagatgtcggatgtcggtggcgccgcgcgcgaatgcggggtgtccgaattgacagtgggcagatatccggcttcagcggcggagaccacgacatagattctgtgtgagattggtggctcgacatcggcagcgaccgcaggcctggactggtctgccgcaaagaccgtctttgagccgctttctcgcccccaccgccggcaccgcctgtgtcagccgccacaatgccaggccagcccagactgtcgaagaaccatcgccgccgttgttgttgtcttcaccagctctcgcccttcattgaatcaaacacatttagccacaccacacacatgacgttcgtttcggcgggtggcggagccggtcagcggcggccgcggaggagatcgtcgctggctcagtggtctttggcttcgacgattggagtaaggggtgagacagcatcacgggtgccgcggcggggagcggggcgacgcttgcggtggcaggggatggaggaggtcacggtggtgaggggagggggatcgatctgggcgggaggagaggatttggggaaggagagcacgtgagggagtggcgagcggtgtgatttttgcgcaaggggagtggggtgatatgcgtgcgggctaaggaggggataggggaaacgtgggatgatctgaggcattggattgaatgattctgggccgttagatttgatgaatgagtaatgagtaatgtaggtgtaagagtgagttggtgaattattagagggtatataggtataggtatatatatagtagggacgatctgaggtattggattgaatgatcctgggtcgttagatttgatgaatgaggatttgatgaatgagtaatgtaggtgtaagagtgagttgatgaattatatggtagatgatatactttactagttttttttatttttttagagaagggtaaaaaataaaaagaaaacatatactctactagtgactttaaagtttcatattccaacgaatctttcaacacttgattaaaattatggaattagtggtgttctggcagcagaaggtgtttgcttttcttacgatttgtttatacacaaatcctactcagtaaaggggaacccaatgctttgctaatgaaagcgtttatcaaagcggtcctgagcacaatcttagtctactttctaatcaccatagatcctccaaaatgggtcttaattgccaaaggtctatgtgctcattggagtgtactggcttaggcatcgacaatctagagcttatgggtgttgcgcttaggtcctgatggatctcggcccaacgcacatctcaatttaagccctagcaaggtctccatatgccgtactctaggcaggaacgcgagtttgctgttgtttccatgacgtgcgtgctaggcgatggcaaatcaattctcttctgggaagatggttggttgcaaggtgcgagcatccatttctaggcgcctgcgctctatgagtgtgttctggagcgcatccactggagcctctcgatcgcagacgtattaagaaacaacagatgtatcaacgatcttcgcggttctctaggagtatggccaatcttctagtaccttttgatctggttgatggtacgtgccacaacactatctgtggaccaagtcggactccttcctctataagtgagaaagctcaggttcctactccgcttgctaaccctaccacgcactattcatgggcaggatcccattccatcactcgctgatctggaatccatggcctctcctcgctatagctactttttgtgattggtcgctcactggcattgctagactgttgatcgtctggagaaaagaggcctcccacaccccgcttgcagcatctatcatgaccaatgggaagaaacgactgattgcttgtggattgagggccctaattcattacagctttgatggatcatcctttcaggcctcgggttacactagtgcttcctcgccggagtctcctcattccatgattggttgtgtgctctagccaccacaagtccaaaaggaccagtgttgtggctttgacatgattgcaccccttggggcttggtccattcgaaaggagaggaacaatctggtgcttaatcaatttaatcgaacatggcttgaagtggtcgcggcaatggcgcgggaagccaccctctggaagctttcccggccttcgtcgcaggcgttgctaccttagttctttaggtcgctaggttgtttcctctgttatcatgagaataaacttaagcttcccctgtttttccttttcccctttttatttccctacctctgttctgtcttttggtttgttatttcttttgttttgctctttgtaagttttactcctcttgatgcaaaggtgcacaattcttttgcgtattcctcaaaaaatgctttgctaatgaagaggtcaaaaaatgcacatttttagtaaggagggaacaatgaagaggaaaacgaacaactttccttgagaaatcaaaatcaacatgtacagaatcactacaacaaaaccccccttcagtgctggctaggaaccctaattggtgccagattccgagatgaccccaaataaggggcataaatgaggcaggctcatcggtgcatgatttaaaacaaaaacccttattgatgaggtgcatgatttaaaacaaaaagtctgatcggctcgattcaagccaattgagcccatgcattgagtccaaaaatttcccaattggttcttcatctatcccaaattgtatttcaatatcaccattgaaaaagtgaatcacaaattttggctcaaatgcattacgtactactcgaattggaaaggtaaaagtacaaattgccggatctgacctcgagctcatggcgaccaatggcccatggcgaggtggaggtcgagagagcgagggaggcacaatgatcggtagggacgttgagaagggaagtagacctcgagctcgtgacggtggatctagctgccctcgagatcatggtggccggatctagccgtccccgagcttgtggcggcgtatccactggcctggaggaggaggcgctacatgtggcggcggtggagatgacaaggggcgtgcggcatctgtggcagataggaggggcatcagctgcagcagagaggaggtggtggtggcggcgagagatcaatggagtgggatcaactctgagagaaaagtgcgagagagaatgaggtggactctgagagagaagagaggtggaaagattaacttcaaggaataaataaaactagggctggctcggtttgtctgctagactctcttagaggtgttgtttttttaaaatgcctcatatgtgggcatccgctcatattggcttgactaccgatttttaattttagattagaccacatgtggagttggaatgaccagaaaatacttatgtgtgctggttttagggcatcccggccctatctggaccttttttaatacctaaaagatagaaacttatttaagaatattcgaataaaaaactgctataatagtcaatggaacagtcacttctctccttggctttaattttcctgtacctagttttaatatgaggtttgaattggtcctgtcatccctatcctagatatatacctataccgacatacagtatatttcctatactcgctttagtaaaataaaagtgttgttttggacttttctaattcaatgagttacaagttcaactacttataatttgtacaaataaaaaaaaggtaacacacgtatgagaaataatttggtacgacaattttatccacataattctagggctgtctgtgatatcatgctcagcggcggagccagaatgtgctcaagagtagggttgaactagtataatagaatgtgccctagctgccctactcctatatccgccccattcatgctgaaaaattgtgtgaaatcagttgaatttttagccatgcgataaaacatgtgtcaaaatcaccacccacccacccacccccgagcgcgccccgccgagcgcgagcgcccttctcacgattgcttctccattaaaacaatactcattgttgggtcaggactgagaaaacatattttatcttttgttatttattgggcttgttttcatattgaacaaccttaacattgttgctttgggctattcaaaagaagctcaaaatctgtctgacatcaacacacaaattctttccattaagtcataacaaacccaacatgagaaggtccatttgtagccaggaaacaacaccagagcgagattgaatccattttgttatcacacaacttttgcgtgacaaagctcagctagcaagattcattagcaaaatccttacaaacaaagaaatcttgacatatcctgtatgcataaatagattaattccaaatgatattaccatctctaatcaattttagcaacaaacttaaatgtatgcatcgcaattaatttgtgacataaatatctgacattatagtgaaggatctgtgttccctctttttcctagacagcaattacgtactgattcatcatactaacatttgtctcatgttaacaaaactaattgtgtccgattttctccatgataagcatggactgttaaatctcactgacatggaaaacccattaaggctcagttttcccaactcatctctctcgttttccacgcgcacgattttcaaactaccaaatggtgtatttttttcaaaaaaattatatacaaaagttgtttaaaaaaatcatattgatctatttttgaaaaaaaaaatctaatacttaattaatcacgcgctaatggattgctccgttttccgtgccggaggggagtgttcccaaccaggaggagcgaacactccctaagactgcagagactaatagagcaaatgggaataaatgcatgaaacatggaccagaagttttgtatgataaggcgggaggaaggacagagattacaggtattcgttgagataaagtgcaaagtcaccaccacctcccattgccaaataatcagtggagcaaaatgtgaaatctatgcaaatcctatgaaagaaattgtataaatgacctgttggatgatataaagcagttgttggtctcctgaaagattaataaatataaagtacgatcagtgtaaagatcgaaatagatatccaaaaaaattgctagaagataatcaagcctagtagtcactaaataaattactctcgaaattttttatgcttcagtgcaaacaatcaagctcagtgcactagcactactaagtagatgcttgatgccttgattgtctaaatttaagctcagtgtactgattttgtaattactaagatatagatagcacacaaggttgacaaaattaggttacgatagttcatattaaaattacattgataaagaaaagtagcataaaccctttttacatagcagtagatctatggaaaacaatcatggagtactaaaatatgcaaatgtcatgataattttttagcatactcagacaaactactgtatatatgaagtcaacatctacagtgcatgcatggcaaatgcaacccatatgatacatgtactacctatactaactcagccctaaacaaaaaaaaaatatcaccaaaaatatatgggttaattgatcaacaattccaaactggtgattttctagccaggggataaatgaggtcgagtcaccaaattcttacattaccaacttgtcatttattaatagcatcttttaggataccttccatttgtcaaggtatagaaaagaaattatccactaatctaataaggcatggagaatgactcgatgcatgccgctttcatatttccaccctgaaaaatgaagcaactaaactataatttgggtatcaaaactagtaagtacaatgactcacatagggcctaactacctctatgacatacgtctgaattcattcagcaaactatgttgcagacaaacctacaaattcatcaagtcaacgatcaggttaacaatcatgtgaatattacacacactttgaacaaaaaatcttctaggtgatagcttatgccctatagagtgggctaatgtagggaatattgcaatttgaattggctaacagataatggttgtcccagtcttacctcttggtggttggtcggcaaagttgataaaacatgtagttagataaccgctagttaaggaacattgtcatatgttatatgcaactactaaatgctaacaaaacaatactattcggatgtacaaaattaattgctcagctagtcaaggattgacaaaactgatttccagatatttggtctagaaaacaaaactaacttttgcagaaatatcaaatggctgacaaaacacaaaactagaaatgttagtagttgagaaaactagacatgagaacttgttttgtacttattattgatgaggtattcagatgcacatagtcatgcataaaattctaatgagtaaagtccatcaccggtccctaaacttgtaccgctgtgtcatcccggtccctaaactcacaaatcaaccgttcaggtactcaaacttgttcgactgtatcatcccagtccctaaacatgcggatcactcgtttaggtcctccaacttgttcagttgtgtcacctcggtccctaaacaggacggtctaaaaactttatatcaaaaaataattcataactttttcatgttaactctaatgaagacaaactttatatcaaaattgtagccctcaacgcgacctacaactttgtagttgaaaagtttttaaattaaaactgtttagggtcccaaaatattgttgcatatttatagattttgtaattttaattttaaaattacattttgggacaaaaatgacttaaaataaaaaaaaattcaactacaaagttgtagatcgcgtcgcgggctacaagtttgatatatagagtttatcttcattagagttcacatgaaaaagttatgaattatttttaaatataaagtatttagaccatcctatttgacccatatgatattcaaatccaagtttagggaccggggtgacacagctgaacaagttggaggatctaaacgagtgatctgcaagtttagggatcgggatgacacagtcgaacaagtttgaggacctgaacggttgatttgcgagtttagggactgggatgacacaacgatataagtttagggaccggtgatagactttactcaattctaattaaagactacctttggagctcttgacactagtctagaactagcacaactactcagtacacctaaaaatgtactagaaaaattacaaatgggacacaaaaaacaatttattttggcaaaatttagaaggttaacaaaaacacagaaaagacaaaaccaaaaccaaaaacataaacagaaacagaaacacagagcaaacaagaatacaatattttgctaatgattggtctttgtgtaggtactgaaaatgacattgagatagtatgcccgatttcttttcagaatccacaacaaacaaaactgatactaatcttttaaaatttacccaatattaatagcccccaagttcagatttttgaacacaaatatcagtgaatttgcaggacaaaacctgctaattttcagtaaataatagacaaatcaatacctgaacataggaaattagcccatggacgatatgttgcttaatttcttcagaatccacatccaccttcatggataagaactgacatcctccatgcatagctaaaactctccttgaaaagaattagagtaaacaaatcaagctaatcaaattcttttaccacaaacttgaaccatatagaagttctaatacttttgaacatgtaaagaaatcaaaacttctgcacacagtgacagaaatgctgaccaaaatcaaagaagtatccaaacatatgaacacattgcatgtcccacacacaatattctgactaacaaccacacacacaaatgaactctgtgtgaaggacccgagaagaacatgcaacaccatcaccaaagaagaatagcaagttactaactactatctcctgcagagaagactgtgacaaacaacaacaaatcagtttgtagcatggcctatagtactattctgtgaattgtacaaaagtactacaagttgtggtaaaaatcttaaaaataaaaatgtataggtacatatgtatgtatgtgctcgcgagaacttttacggtgtttgcattccaaaaaaggtaaaaatccaacgctcctcaataataggtaccatgtgaaaagtatttaagtattagtataggtacttagatatcaagggtaaaaacataaatatacttgttgagagaaatggtagaattgtccctaaatttatcggtaccgcataggtaccggttaagtgatttgcttggtactagctgttctcatttgcatgattttctatagatttatgttgtgttctttgagattctcatctgcatgattttctttatatttacatacgttttgttccgaagaaaacgttattggtgtaaaagttttcatttgtgttcccttgtctagatttacgttatgttctcaagaacatgtcaaaatccctccgtttaattcttttgagatttatatcttttttactagaagagatttgtattgtgtttcaaaaacatgaccggttaaaatatcaccgaagatttgcgtcgatttaaattatataatattttatcaatttatccctataaaacatgaaacttcttccttgactacataaacaactaattaactgcgtaaataagtcatggatatctctaaaggtagctagagaagaaaggaaatgtgatctttgattttttttctctctctccgatacagattgaatcaatcgctaaattaacagggtagccatgatttacgttttcatttactcatctcctatcatgttacaataattttattccgtacctgacccctccgttgatccacctttaagtacctctaagtacctcgcaaacaccgtaaaagatctctaggaattattgtgtagagtattttaaatcacatacaagtgtgtcacatcatcacgtactaggaattattttatagagtatcttaaatttcatgtaaacatgatatatcatttataattttgttgtatttttagaatttaatatgcgagcaatgtgaaattatcatctccatatcattatcacattatttaaacatatatatctatcttttatattatataaaatatgcattcatccacatatcctcagcaaaacgcggaatatcaaaactagtatagtatgcatttcaaccttgttcgacgatcgctcaggtttcgatgtcatcgctggagaacatgagcacggtcccagactgcggtgtgccagacatcaccacctcctacttgaggtcatccaagagcaccatcgacctcttcacggcagcagctggctcccctgtggcggcgcacagcataatgtcgccaccgcagttcatgggcgccattgacagggaggccagggtgcaccggtacagggagaagaggaagacgaggcggttcgagaagaccatcaggtacgcgtcgcggaaggcgtatgccgagacccggccgaggatcaagggacgcttcgccaagcgcagcgacaccgaccttgaggtcgaccagtacttctccaccaccgccgactccagctgcggcgtcgtgcccacgttctagcgagcagcttggccgcacgcctggaagacaatcaaagaagctcaggaatgaatatattctcccactgtatagtacatcttggttgcttagctatatatatatatatatatatatatatatatgtataattcgccgaatcgcctctaaatttgtgggaggtatgaggcttcagctgtaggtatatatagatgctagaaagatgctccttgtaaaattgtgcaggagtaaatgtaatcatgtagtcatccctccttctccaatcctttacaatacatttctgtttttttattcagcttaaaaactacgttttgttttttctcccgataacgctattgatctgatggtaaattttgatcaataataattctcgttcagaaaacaagacagttttgagtcccttttcgcacactatagttactgcgtgtgcattgcttggaaattccatgaataatgtttgaagaattgcgttgatgcttcaactttgggccactttggttctcaaccctaccaattctttagtactgagagttgacttgattacatttggttcgttacttatagagagccagtggtggatgtaggtttaaaatatagatgggacgacggagctagccctaattagatgatggcacaatacatacaatccatagtcaccggctgatggcggcagagctaactctaattaggtgatggtacaatgcacacaaaccatagtcgccggctcatgacactggcgcagcagtgcacgacacggatatcgagaaagttaacaacgaaaattggtagtcgaacaaatatatatgatttatatgtagagagagaaaaagagaaatgttgttagataataataaggggaaccactttcaattggggttataaaacaagatgaaaaattatttaggggtttaagtgcttcgccaaaatagttcaagtgagtaaaatatatttttttatatatttaccaatttaactatttactgtgaattgtatagaaatagaaaaaaattatatatagtcaaaatcaggaacagtcaaaatggtactacttacacagaaataatacttataagtcacgaattttcataaatatttttgtctctacttaaaatatttgatttatctgattattcaatagtagacggatgaataatgtgttaaaaataggtctacaaataaggtttaggggcgtagctgcgtggggcgacacggatcatagctggaccggccgaccctccctgcctaatgggtgcgtccaccactgtagagagctaatgttgccaaactaacctttgtgttcaatctaaaccacaaaatagagcctaccaaaaggttggtagggcacaaattgcacatcaatatttaaaatgtccctttctcttctt

SEQ ID NO: 750 - DNA, 3752 bp, Oryza sativa
atttaggcctcaaaccaaaacagcccgttactattgaagttgccaaaaaaaattggtaggacaaaaatcaacctcaatccaaacatgcctaacatgtctagtactccttctattttaaaataaacgagtctagtaatgtagcatgtctctctagattcatagcccttgaatacatcatatttcatactaagcttatttattttagcacctaaatatatcatattttatactagtctgtttattttagaatggaagggagacgcaaacacatgtccactagccttggtgtgcggtgccaactggccaccagcagcaggcagcagcccagctcagtgctgccgccgcaagtgtccagcgtccagcacgcaccaagccctacgtgaaggatccagatctcgcacgagatttgccgcgtccccactccccccacccacggtggcctcggcttggccgtggccgctgacatggcatcacctcatccgcaaagcgataagccgggagcgcaccagccaaccggcgcgcgacacctggcgcgagaggcgacggtgacagtcggacgggtgggcccctccctctgtccccgttgtccccgtgcgtcgcaggcgcgcgcgtcgcgacaatggtggcgcaaccaccgctctcctttcttttttttttccttctcttcccgcagaggaaaaggacgtgcaagtgtgaacggcatctggctagatgtactacagtcctagagagctcgtgcccatcgcgatgtacaaagtctttttctttcttggcttttttgcgtgcttctgtgctagtagtagcaggaaaagcagagagatgggttcatggtggccatgttgcgtagcaagtgatttgatccgattccgtgccgcctaaaaaccgttggttaaactatgggtctcatacacatcgcgatcaaaacgaatgcaagagcgtaaaggtatactcggataagcgctgaaaatgcagtagtactggcagtgccgttttgcaagcagcgcgagatggcgaccctctgctgctgcgacggcgatttgccggctcggccaatgcggagccgtcagctctccgctgctcggctaaacaccgggcaatgtgagcgagagtacgcgcgagacgcgagccgacggggggagggagagtgaccgcgcgggtcggacggtcggtcggaccacactcgcgcgcgcgtctcgtggccgggagtccctccacgtgccacggaccccctcaaaaccccccgcgaatagtcgaatcccccgtgcccaacgcccaaaaaacacagccaaactccgcgagaaaccgagctgcgagcgagtgaaacgcaccacgcgccgagcggcaaagcgaagcgaagaagaaatggaggcggtggaggacaaggcgatggtgggagtgggaggagcggtggcggcggggtactcctcgtcgtcgtgggggttggggacgcgggcgtgcgactcgtgcggcggggaggcggcgcggctctactgccgcgcggacggggcgttcctgtgcgcccggtgcgacgcgcgggcgcacggcgccgggtcgcgccacgcgcgggtgtggctgtgcgaggtgtgcgagcacgcgcccgccgccgtcacgtgccgggcggacgccgcggcgctgtgcgccgcctgcgacgccgacatccactcggcgaacccgctcgcgcgcaggcacgagcgcctccccgtcgcgcccttcttcggcccgctcgccgacgcgccgcagcccttccccttctcccaggccgccgcggatgccgccgcggcgcgggaggaggatgcggatgatgaccggagcaacgaggccgaggcggcgtcgtggcttctccccgagcccgacgacaatagccacgaggatagcgccgcagccgccgacgcgttcttcgccgacaccggcgcgtacctcggcgtcgacctggacttcgcccggtccatggacggaatcaaggccatcggggtaccggtcgcgccgcccgagctggacctcaccgccggcagccttttctaccccgaacactccatggcccacagcgtaagcctcactaccacacagctagctctcgtcgatgctcatggcgcggcgttatgacatggtttcctacgcgttccgcagttgtcgtcgtcggaggtcgcgatcgtaccggacgcgctgtcggcgggctcggcggcgccgcccatggtggtggtggtggcgagcaaggggaaggagagggaggcgcggctgatgcggtacagggagaagcgcaagaaccggcggttcgacaagaccatccggtacgcgtcccgcaaggcgtacgccgagacgcggccgcgcatcaagggccggttcgccaagcgcaccgccgacgccgacgacgacgacgaggcgccatgctcgccggcgttctccgccctcgccgcgtcggacggcgtcgtgccgtcgttctgaggaaggacgtacgcacggtacggcgagtcggcgacgtgcgccgtcgtaattttggcgcgccccgtgcgcgcgtgcatgcgtgcgtgtgtgcgacgcatggccccgtgtgacatgaataatatgtacagtagtttttcatccatggacgtagtattctattgtactccttgtactcctactactcctcttctgcctaaccaaggcttgtacattaccatgggagtagctgtttttgcaaccgtgaccatggttcagtgcttcaagttcaagggcgttaatgttactgtccattctacttttggaaaggctagtactcctcctacttgctactagaagcttgccgaaaaatggtaaagaaaaatgtgcaagaacgaactgcagtactcatatctccatcaaccaggaggttcgagcatcatactactctattatacgagtgtaatcatcaaccaataactcccctaacctcacagtttttctcctgattttggtttttttttggatatctgactgttttacacgtctccttttactgttctgtgcacctcggcctaatttgcatgcttatgcgttgccggtgcgccggttgattacgtaattattcatgtatttggggtttggatgccggtcattgtgacggttgtttccggttggctggtgcgttgagtgccgcgtgccatgctgccattttttgttttgatctaattgtttcttctgttatttcagatcggtctatccgttctgtattctgtgtctttgtgactttttgtttaggtccttggtatttttgaaaattgaatgtgaagaagacaaaattctgtttttgggtgtgtttgtggtttgttcttctgctgggtatggaggtgcgattttccccacctgccgtcctccctgctggtcacaccaaatgcctcatgctccgccgccatcgcgcatcttcgtgctctccggtgagagcgacatgggcggccgcggtggcgtccaccaccggcgctgggatggcgtcgtgccgacctagtggtacatattcaaagcaccctttacacagctttccgttcgtgctagtttctgttacgtcttttatttacctgtgaggtgaaaccgtgcaacaacttccgtattgggggacacggacatgtactgaaccacgtaaaaagggttggaatcattgaagccttttctgttgcagatgccatggaagtttgatggctgcagccgcgtagtgcaaccatgtgacctcggtactagcgtacaccgctttggcacaaagccatgtgaagcgccgtatcggtgtgcccgtgccgggtgtg

SEQ ID NO: 751 - DNA, 4912 bp, Oryza sativa; identical to SEQ ID NO: 560

SEQ ID NO: 752 - DNA, 11093 bp, Oryza sativa
aaaaatagattaatatgattttttaagcaattttgtatataaaatttttgcaaaaaaacatactgtttttagcagtttaaaaaacgtacgcgtgaaaaacgaggaaagtgagttgaaaaattcggagaaagaactcagcctaaatttgtagagagagaaagagagatgagaggaaaatagaactaaccttgtattttgggacgcatggaataggagcttatagcaacttgttgactttactattaaatttgctcttatcactttaaccgtgtagatccagtttgaatacagaggctaaattttatagccccatcgtttggcctaaacagccaaagaataagccaaaatttgaatttttgaacttgattttgaagttgattttgaaatgcttttaacgtaatttttgttaatgttggcttttaagtcgctacgaacaaatctacaaaagttttacttataaattaattttaattttctaataagccaaataagtcattttgggtaaaatgacaaccgatgggagccttagtcaactctctaaaaaaagtaatcattcacttgcaaaagaaaatggatatatacctccactttaaccgcttaccatgatagtacctcaaaaatcatagggaccatttcgcaataatctcacaacacaaggactagaaccacaaaatccatgtcattggccatggccatggggggtcatgcatgacgatcaccaagcatacatacatacatacatacatgccatgcacccccgaaaatatcaaggccatgtcagcaatcgccaggaggcgatccgccaagccaagcaaagccttcccacccccccgccgcactcacgaataagtatctcaccccgcagctaccccacccgcctatcaccgacacgtgggccccacatcacccgcccccacgtgtcggcgacccggaaccgccgcgtgggcccccaccccacgcgcgcgcgcgggtgggaaatagcgcggccactaccaccaccaccaccaccatccccggaaaaaatctttttctcgcctctccttcctccgagccgtttctctccctctctctctcctcctccttcccctgcgcctcctccaccgcccgtgtcgccgccgcgcgcgtctatcccctcgccgccgccgccgtctacgccgcgtgaggtccggattggttgaaaggctgatcgaggtaatgcttttttatttttcccgtgcggttttagtttttctgtgctgtgcttggtggttttttctttaaaactatttttaggctggttttgatgatggcctttctaaggttgtcgtgtatggggggcgaggtggttcgggtggatttgtggtgttatgttgaggggatttttgtttggggggagagagttttggtggtagatgcggttgggattttgaagacgtgaaagggaaattagttttgaaatttgacggcgaggttgagctgattagtattgtaataattcgtggcatcggatagatcaacgcgagatggatgcttattactgcgaatttcaggaggtttttgtggtttttttaggcgagtagcgttgattctagctggattttgctgcttcgtggaggcgtttagatgtggtgcatacggctgtggatgtaatttgtgcggggataattactgaaaattaattcgcagtaagctagctctgctttaatattttttcccctgaaacagtaacaagggatcccttcctcatttcgttaacagtggaagtgaatacagacaccaaccgatgagcagagacacctgtaattaaacaccaaaagaagaacctgttttgttcctatatattttccatttctatgctttaggtaatatactttctggttcggtgtcatagtacccgaaatagaatctttgcttgccaaaaaaagaaagaataacaagatagaacaacatcattaaattctgtcttagacaatacatttataatcgaccaacaaaaacagaccgatgagtgacgtggaataacaaatgaagtataaatgtcacgaaaaacacatctattgattttgtgtgataagccataggagcctacgaggaaccaagtgaatggttctgtacaccacatccattagcattaccataaatttgcctatttctatgatgccttccttaacatatttatcgacatgtgagcttgcaccataactaaatgttatggtaaactttaccttataaatgattgcaacatgtaccttttcatttcgataattaaaaacgagaaagcttccacctttttcctagatatattttttcgtttgattatgaatttagttgtacttgacaataaaataatgcgcttgtaagattatgcaattttcgttgcattacctccctctcttttcatttgtcagtttttttctactccctccgtttcatattttaagtcgtttgacttttttcctagtcagactttgttaagtttgacaaagtttatagtaaaatttagcaatatctaaaatattaaattggtttcatcaaatctaacattgaatatattttgataatatgttttttttgtgttgaaaatacttctatatttttctataaacttagtcaaacttggaagaaatttcagtaagaaaaaagtcaaacggcttataatatgaaacggagggagtaaatttttttttgcattaattaaaattcatgtattttcctccttttttggtttttgttgtgcgatatattacagtgtagagactctgaagctcatatggttggcattggttgatatgataacgtgtcacgttgtgagatgcagacccccgttatgggggttgattgaatgaagtggatagcactcttataactttcttgctcgaagtttcttgataccaaggcaagtagcttataagaagatttggactttggtggcataaatggatgaactaactggcggcttcaacgtggtgttgattacaggtgcttttattgctaactggagcagtttgtgtagtttctttctttctctttgagaattctctcagtttcttgggcaggctcttgagctaccaagtatgtcagcttcaaatgagaagtggattgatgggctccagttctcatcactgttctggcccccaccacaggattcacaacaaaaacaggtaacattattcctatttgattcttgttagaaattctatatgttgaacatacttgcctcaatgggaaacttggttgcgtctcctctctgaaggcacaaattctggcctatgttgagtactttggccagtttacagctgacagtgagcaattccctgaagatatagctcaggtactgtatctctaagcatgtttagtatcttctgtgataaaatctttctccagtgtgttaacttttgcattctttttcttgcatgcttgcagctaattcaaagttgctatccatcaaaagaaaagcgccttgtagatgaagtattaggtaatttgatccagtgatcaatacatgttccacaaacaattgaagaaagagtttgacatatttttctcatatttccagcaacttttgttcttcatcatcctgagcatggccatgcagttgtgcatccgattctgtcacgcatcatagatgggacactcagttatgatagaaatggtttcccgttcatgtccttcatctctttatttagccatacttctgaggtaaggcccctactctaatggttagttccaatttattggttcatttctctgtgtttgataagattttgcctctgctgtgcatttcaatattatatctaaactgtgctgcttatagcttatcaaactactcttgctcataaagatgcaacttttatgcagaaagagtactcggagcagtgggccttggcctgtggagaaattcttagagttctaactcactacaacaggccaatcttcaaagttgatcaccaacatagtgaagcggaatgtagcagcacatctgatcaggcctcatcatgtgagtctatggagaaaagggctaacggttctccaagaaatgaacctgaccggaagccattgaggccactatctccttggatcacagacatattgcttgctgcacctctgggtattagaagtgactattttagatggtgagtcataataaatgataacatattattgttctgtggactgaaaatctgaaatcctcctttcttgagaaatacaacctcaattttatggtgatattgacaagaaggaagagcgcatataatttaaagttaaaacacggaaaataatagaagtatgtgagcagaacgcaggagcaaggggtggaactcataacaagttcaaacttcatgcatgttcataattccccaatgcaagtatggcaagaaaaatagacaacttttaaaagtatgctaatggaactgcatgcattgtgtaaacttgcttttgtcaagcatgttggaacatactatatatttgctgctgatgatgaaaaatttgcttgagtactcttctattgctaatggacgcttaccattccctgttttgtcttcaaatgcatcaggtgtggtggagtcatgggaaaatacgcagctggtggagaattgaagcctccaacaactggttggtaaaatcagcaatggaattttctatcgtgaattttttataattattgtaacattaattactcccatgtctttttattctgttgagataccatgtgacaatgtctacaattgcatattttgcattctttggtagatcagttcccttcttaagatccccaaagggaaactggagtatcaataacttactccctcaaataaaaaaaaagtgatactttaggcataaacacattcttcaaaacaaaactttgaatagcagtttcttttgtaatatattaataaagcatggaaaaattataatgtgaagaatgtacattcagggacaaatatactcatcatttttgcatggttgatcttaatgtccatagagagattgatcagaccaaaagtttatttttgacaggagtgagtatggattataataggagtgaatggcaatatgctgtgaaagtgagcattttatatttgtttactactagcatttggtgacaaagcaaatgatgtatattgtaaatcaaagtaaacaagtagaacatgtcctgtggcgacaagacataacctacaaattaaagttagcctgattgtttattttactgggagcacattttttctagattctagagtacatattattaaaaaaggtgtgatatgtttgcaaattactttttaatggaagtttgtaaattactttgaaacttgcattcagtttttttgcttcttaaaaaacatagtgcatatgggctttatgagctcatactatgcatgtttttctgcattggagtgggacctttatctttttcttgcaactcggatgctaatgcttattataaacacaagttactaacatgtgcttgggtcattcagcttacagccgaggatctgggaagcacccacaacttatgccatccacgcccagatgggctgttgccaatggagctggagttatactaagtgtctgtgatgaggaagtagctcgttatgagacagcaaatttgactgcggcagctgttcctgcacttctattacctccaccgaccacaccattggacgaacatttggttgcggggctccctcctcttgaaccatatgctcgcttgtttcataggtaagctcttatgatcctgtccactgttgtaccatgtgtactttccaaatgattgctaacatgctatttttcgtcagatactatgcaattgctactccaagtgctacccaaaggttgctttttggtcttctcgaggcaccaccatcatgggccccagatgcacttgatgcagcagtacagcttgttgaactccttagagcagcggaagattacgattctggcatgcgggtatatcatacatctctctggctgttgtttcagtgctatcaatcaagatgacacatcatgcaatattatcataacagcacattatgtgttttgaatattttattgattgtcatagctttgttttatgttttagcttccaaagaactggatgcatcttcatttcctgcgtgctattggaactgcaatgtcaatgagagctggtatcgctgctgatacgtctgctgctttacttttccgaatactctcccaaccgacattactttttcctccactgagacatgccgaaggagttgaactccatcatgagccactaggtggctatgtatcatcgtacaaaaggcaggtatgcagtgtttcctgcacctacttgctacctattctgtatttgatgtattcaatttcctttttatcagttttctcgaaatatatgctaataggcttgtcactaaacggctacattatccagactctgttctgaatttttttttcattaagtactgttagctgccagattacatcatcatgactaaagtagtttagctacaatattgcaaagctagatttgtctagcctctattgttttgaatagaaaaggcaggtatgcagtgtttcctgcacctacttgctacctattctgtatttgatgtattcaatttcctttttatcagttttctcgaaatatatgctaataggcttgtcactaaacggctacattatccagactctgttctgaatttttttttcattaagtactgttagctgccagattacatcatcatgactaaagtagtttagctacaatattgcaaagctagatttgtctagcctctattgttttgaatagaaaattaaatcttttggtcatttttttgtaaccttttaggagtctctgtatgcttgtcgtcaacatgctatgataagtttatatcagttcttttggagctatgatgtattcttgtatattttatgactgctaggatattatgttaaaactgttttaaaggtatcatcaaacaagttaatatagatattgctacctaccaaagttggaatttgattatgtcgtaaaatatatgcaccctacatgttttagcttcatattgacttatattttcatatgtgctccttcaactgcacaaagctggaagttcctgcatctgaagccactattgatgccactgcgcaaggcattgcttccatgctatgtgctcatggtcccgatgttgagtggagaatatgtaccatctgggaggctgcgtatggtttgctacctctgagttcatcagcagttgatttgcctgaaattgttgtagctgctccacttcagccacctactttgtcatggagcctatacttgccattgttgaaagtatttgagtatttacctcgtgggagtccatctgaagcatgccttatgagaatttttgtggcaacagttgaagctatactgagaagaacttttccatcagaaacctctgaacaatccaggaaaccaagaagtcaatctaagaaccttgctgttgctgaactccgaacaatgatacattcactctttgtggagtcctgtgcttcaatggaccttgcgtccagattactatttgtagtattaactgtttgcgtcagtcatcaagctttgcctgggggaagtaaaaggccaactggtagtgataatcattcctctgaggaggtcacaaatgattcgagattaaccaatggaagaaacagatgtaagaagagacaaggaccagttgctacattcgactcatacgttctagcagccgtttgtgccttatcttgtgagctccagctgttcccttttatttccaagaatgggaaccattcaaatctgaaggactccataaagatagtcatacctggaaaaaccactggtatcagtaacgagctacacaatagcattagctcagcgattcttcatactcgtagaatacttggcatcttggaagctctgttctccttgaagccatcatctgttggtacttcatggagttatagttcaaatgagattgttgcagcagctatggttgctgctcatgtttctgagttatttcgtcgatccaggccatgcttaaatgcactgtctgcgctgaagcaatgcaagtgggatgctgagatttctaccagggcatcatccctttaccatttgattgacttgcatggtaaaacagtgacctccattgtgaacaaagctgagcctctagaagctcacctgacccttacaccagtaaaaaaggatgaacctcccattgaggaaaagaacattaactcatcagatggtggtgcattggaaaaaaaggatgcttcaagatcacacaggaaaaatggttttgcaagaccactcttgaaatgtgcagaagatgttatactaaatggtgatgtcgcaagtacttctgggaaagccattgcaagtttacaggtggaagcttctgatttggcaaacttcctcaccatggaccgaaatgggggttacagaggttctcaaactctcctaagatctgtactgtcagagaagcaggagctatgcttctctgttgtctcattgctctggcagaagctcattgcatctcccgaaatgcagatgtctgcagaaagtacatcagctcatcagggttggagaaaggtatggtcattcctgcttataagataccagaataatgctatgaagaccgtccttggttgtcagcattcttatacacaatgataatctttgtttttcatgggtaggttgtggatgcgctttgtgacattgtttcagcctcaccgaccaaggcttcagctgctatcgttctgcaggtcaagatattgttattgttatatttacatacttgttatcatatttaaaagcttcatattgtatgtacctttgaaaaaaaaagttccatactgtagcttcttttgttctcatttcttggtttcaaagcatcagcatcattaccgatataaaatatacccatttcctcagtcatcttccccgactcttgtatctttcacaggccgagaaggacttgcagccctggattgctcgagatgatgagcaaggtcagaagatgtggagagtcaaccagcgaatagttaagctgatagcagagcttatgaggaaccacgatagcccagaagcattggtgatccttgctagtgcttcagatcttcttcttcgagcaactgatggaatgcttgttgatggtgaagcttgtactttaccacaattagaggtaacaccttcattcatgaggtccttaggtgcaaatcccagtgaagaataatcagttctactttgtatggttcatctcgcttactgaccggttcatctcgggatcaattacgagcagctattggaagtaaccgccagagcagtccatctcatcgtcgaatggggagattcaggtgtatccgtcgctgatggcctctccaatctgctgaaggcatgtcctcttctctgatctcactcacgttcatgccaaacttactcatcatcatccatgatccatcatcctgactgaatcttgatatgcagtgccgtctatcaaccaccatccgctgtctttcgcaccccagcgcgcatgtccgtgcactcagcatgtccgtccttcgcgacatcttgaacagcggacaaataaactccagtaagctcatccaaggggaacaccggaatggcatccagagcccaacctaccagtgcttggcagcaagcatcatcaactggcaagccgatgtggagagatgcatagagtgggaagcccacagccgccgcgccaccgggctgacgctcgccttcctcaccgcggcggcgaaggagctcggctgcccactcacttgctgacaaggccacaccatgactgtcactgcaagcagctgctgtaggatcagcgagtaggaaaggatgacttgccggccagtttcctgagatgtgatttaagactgatattagctgatgttcccaagcatgatacggggcttgctcccaagatgtgatttttactttacttttggttaatgtgctaccgctgacattagatgttcaagcatatgaaaactgcttgtgctgtaacttgtatgtctgtaacgtaaaaatctttccatatggtaaccggggaagcagaggtatatccttttctgctgttgtatctatttccagtttcctgctgaacttgcaaatgaatattcagcaatttccgttttgctcgtagttcgtgaacgttcagcggtggatcatctgtaactctcatttgtttatagttcgtcacgaaaatatggttccgactttctccttttttttttttttttgattacgagtgttttgcacttttgcaaaaagctccacgcgtttcgacggaatatcgcataggtcctcggaccgtctgacaccctgttatgttttttacgtataacccctcgtcctcaaaaaaatacaatgcgaagaagagaaaattccacttatagggtgttatgtttcttacgtataacccctcgtcctcaaaaaaatacaatgtgaagaagagaaaattccgcttatagggtagcgctgcaaattagaaacaatgaatataaacgatgcatttgattcggtaaattcgttaaattatgcaataacacagcagacagacccgagtaataattgacaagcgtgagatcatacgtgttccatttccaccaagcgctcggttttttgagaatttgatttgatggaaaacttactctagcagaaaagtatcaattatcaaaggacacagacttctctgtttacattatctattatacaagactttcttctaaccaatgtatggtctgaatatctgtaaggttacaacaccttttaactagaaatcattcacacaccaaaagagagtgcaaaaaaaaaaaagggtgaaacaatgctctcaggctctctgaaccaatacagctttaacagatatacatggaacacagcagtaaattcatcaacaactaatgcaccatcctcgtcctcctgatccttgttaaccagagcatggtttttgcaagcaacagaaaagaactaatattgcaagcacaattacgctgaagcaaaggttgcagcttcaatctttcaatcaacacgcgggacctgaaggggactttcttggttgtaatgtacaagatgtcagaaaaaagtgaagatgatatcgaca

SEQ ID NO: 753 - DNA, 3939 bp, Oryza sativa
ggatgtaagtagactttgtgttcttatcttgtcctttgtttattaattctttctgaagaaataggaattcttatcttgcaatcgattgtggttacatatcctcatcaatatgtggtcctcatcttatcatggatatgatgcatgtacatatatatactttgcattgtgtgtggttccttcccttttgaatcaagaaaataatatcaaaataagtatctagtaaggaccttgctctgcattaccgtttgcttgtgtcacggatttgtcttgtttcatctgtttcagagatgtgtcctgccttccttgttatcttgttcttttcaaaaaacggacaggaaatcttgatgtcttcctggaccagctgctagctagattcagcttgttgtagttaaaaactactgctactgctactaaatgttacagaaactatacaagttatcgtgcttaatcattagtcctgtcacatgaagaaactccaaagtttcatgtgatgtagtaccaagtcccaacaaaaaactaccagatacagtacaatccagagataagttacctcaactcctcaaccagacaagaaacaagaagacaagcagaagagggcactggcaataatattcatcaaagcaataaactggaaccatttccacagaagtaaattcagaaatattttttagataatactgagaatctcagaaatcttagcacagtaagatatatacggtctttaatctaaccttgcagaacaaagaaaaatagctagtacagtagttatcacctaaattgactcgactcaagagcagtcaaatgtaactgtcaattagtaattaagcgagtgaaattgttgtgctagtactctctgctgtccccaactgattgcgccccacataatgcaagaaagagatagagagaaaatgacttatcttgcttttttctaaggaaaaagaaccaaatttggccagctatatggattagatttagcccactgctagctcagagccgcctataaaagacgcccatatgcccagccatcccacaggcagaggaccatcctagcaaacgctgcacttgtgctcagttcgtccccatgctacaccaatctcttcagaatctatctcagatcggcacttacctatagctgaaatgatcagatatcctcactaatcaggtactcccaagatgcaataaaacactatttctttcctgtttttgttcttcttcttgatttctactccgttatgttaatcttggcagcaatagattctgttgggctagatatatatcttgcgtatgttgatcagcatttttggttgggagttagattctgaatttattgctaatcatgcagttgcatactcttgcatgtgtttctgctgacacgagctcatttaatttgcagttaattgcagtggtagtagcagcagatagctacaggcgagtttagctagccaatttggaagcctcgccggcggcgaccgcgtcatgtacatggacgccttcgggtggagcgcgccagccgcgccgtgccagccgagctgcggccccggcggcgacgacgacgacgacgtcctcctcgccgccgtcttgggcgcgagcttcgagctccactccctcgtcgacggcggcggcaacggcgccgccggcgccgttcgctctgacgatgcctacggcctcgacgtcgacctgccgtcccaccagatgagcctcctgcgttgccaagatggtctgagtgctcttcacggcgacgcgtccccgacggcggcggcggcggcgttccttgactcggtggatgtgttgccagtgccggccatcgccggcgcgacgcacgacgacggcgggctcctcgataggttcgcgttcccgaacgttgccgagacgacgaccgtgcaagccgccgcgtcgaacaccgccttctccggatacagcagcaacaccaccggcggcggcaacatctcctccggcgagtcgaacacctacacggaggtggcgtcgacgccgtgcgccgtgtcgacgacgacgacgacgacggctctgcccccgtcgaagcggaagctaccagagaagtaccccgtcgtaggcacatcaccaacgacgaagaccacgacgacgtcggagacagccgcagagcgccggagcaccaagagaggggccgggggcagcagcagcatcacgttcggcggcggctgccacggcgccggtgcggcggcggcgctgctcggctacggccgcgggtacgagccggacacggaggcgatagcgcaggtgaaggagatgatctaccgcgcggcggcgatgcgcccggtcaccctcggcggccccgcctccgcctccgacccgtcatcccggccgccgccgccgccccagcggccgcggcgcaagaacgtgcgcatctccagcgacccgcagacggtggcggcgcggctgcggcgggagcgggtgagcgagcgcctgcgcgtgctgcagcggctggtccccggcggcagcaagatggacacggccaccatgctcgacgaggccgccagctacctcaagttcctcaagtcgcagctcgaggcgctggaaaccctagggaatggcaatggcaacggcaacctgttgcaccatggctactacactggatcaagaaatgctactgctactgctgctactggttctagcaatagcactgtacttgcatttgggcgagatggacttgctggctttgtgaaatccaataggaatttgcaattgtagtactgtgtaccatgcatgattcatgcatgcatgcaaggtgtgtattcgtgtgagtgacatatatatattttatacatgcatgagacaaatctcttgctgttcaagctgataaaaattaatgcttcatttttaccttttgatcgattgagaggattttatatgattaacagtgtgtaactagggctgagttcttattttacttttccgactcatctccctcgtattttacacgcacgctttttaaattattaaatggtgtgtttttttaaaaaaaaattatatatgaaagttactttaaaaaatcatattaatatatttttctaattaatgttagctaatatttaattaattatgtactaaacgctattttgttttgcatggatcgatgcagtaataacgtatagtacatgacattgacatgagtaaattaatcagtgatctcttttttgcccaagtacttcaattccaagggtaaaaatgagagagagaaaaaggtgtatgcactttctgtctgcctgacatcgccgaactttttccatgttggacgatgcaaaaaaccatcagaaagacctgctccttttgttgctaaaatttaacagcctttttttgcaatgcatgcatgcaacgcaagcaagcaaagaaaacacaaagtaaaattggaatcatgatagttctgatgattgattactatagctaccacccctacacatctctgaattggaatcacgccacatatgatgtgagaaaattggacaggaattgatcagacacaattgggacatgtacatatccatgctttgtgtcccttttgacatgatcatctcttcctgggtgttgttgctgtcgaccatgcatctgggcttgaaatgtgccaatgtgccattggaattggaatcgaaatctttgatcttttgccggctgcagggcactgtagcatcttgcatttgcacgcctttagctcgcttttttttgtgtgtgtgggttagctaattgagcttagctaggggaataacaagatgagaaacggaatgcatatgttggtgttggtgtatcggtaccaccacgctttgggctgcccaatgccaaaagacattccctttgggcctgacccccatgtgtggcagtgtacccctgtcccctctctccattctggagtactacacctcgtttgctgccaaagcttgctaccttgagaacaccaccactgtgcac

SEQ ID NO: 754 - DNA, 7109 bp, Oryza sativa
acttacatattcttttttttaaaaaaaaagagaatgctcgaacggcatagtcaaaagttaacaacattatattaaaaactaaaggtattataagcatgtttagatattttgaaagtacagactaagaatatattatattttgaaataaagataatataagcattttttagtttttttagtacaaacaagaaaagaaaaactatgatgccttttattaaataagaatagttgtaaagggggagatggagaaagtaatactctgtgaatacttatatttttataaaaaaataaaaatgcttatagtttaaaacgatggaaatagtgttcaatgtgcgtggttattttaaatgtttagggcaacagtaaatgtgcgcgccttaaagcaggtacaatagagactataagccagctataaatatattttaaagagataagggaagagagagaagagcagcgggctacagatctgtaagtcagctgcagcacagactccaaaacgtaatgtgtgtatgataggtaggaccaattattaatagtatagtaagcaattattgtatgaattggctattacattagctataaataatttggagctagtagttgattatactattaaacttcttattatcaagctaatggctctcgattgtagagggcgcaatacaacatcaatggagcatgagattttgttctacagcttttaagttaaatccatcttgtttacagataaaaagaagtgcaaggggctaattttggcgacccctcccccatctttcaagcctcaccgcaacatcccaccagtgaatcgccagagcgcgcgcgggcggcagtgaaccgaaaccaccaagcgcatggggcccaaatcaacccaagcgcaagcggcagtaagcagccagcgcgcgcgcagccgcccacgcacgcagcagcagcagccacccgatcgaccggattcaaaactcgaaacgggaagagtcgagacgagagagagagagagagagagagagggagagccattcggcgcggcgcccgcagggaatcccgatgcggggggaggagagatggcaggagcagccagccctcgcctcccacccgtcgcgtgccaccttgcgcccgcgcggttggccgcgcctcggcctcgccccgacgggcgttggctcctcctgcccacctgcacccgcctcagagctcgcacgccacttggcgcgccgcgcccccgtctccgcgtctccgcccgtcctccctcctataaaagaccagggagcgcggcccccaaccctagccgcctccgccgccgcagcgtcctcgcctcctcctcctcctcctcctccaattcctcctcttcctccctccacctcgacctccgccgcccgtcccaccgacatggccggggtcaccagcaagcgccgatcctcctccgcctccacctcctcctcctccggcgacggcgccgccgtctccgaccggccgcggggggtgacccggaagcgcaggtccggcggccgttgcccccgccccgccgcctccctgaggccggccgcgccccgaccctcctctgtgagtgcctcggaattcacggactctcctcctgttccgcggttttgcttggtttctccgtatatgcgtggagatggtgggccgttggtgttgtcggggaggcgccgtgggctggaggcccaggcgagagaggggcgatcgtcggctcgttccactggtcccaacgtcgccggattataaaattttggttggaagaagctcgcagatgtgttgatcttcctgggcgatttggagccctgatttgctcgattggggaaatctgatcaacgaatttcctcgattccagtagctgactcgaataccatgatcagatttgagcgatctatgtgtacggtgtttgatcaatcgacattttttttaggaaaaacttggctctcgtttttgcttcaggcgtgatccgtattgcttaagtcataggttatggcaaggaataattggggcggttctttgtcggattcctgatagcgatagctcgttccagggtagttttttttttttttttgtcagtgatgattagtataagtgtataacatccatgttcctgggtcaatcagagatggatttcgtggtccacgtgccgtgtcacgtgacacatgaatagacgatttgctgtggcgccctgtgggcttaatctttgcccttttcagggtagtaacaatcgcataatcagtggatcgtcttcgtcaatttgttgatttagttatgttaagtattttggggtgttcggtgctctttttgttgtatttatatgttaggaatgctgaaaagttggtagaaattgtcggtatttgtgtatgctctcagcagcttgctgcatcacaaagttggtaggagttggcagtacatgccatgccatgtcaactcgccatggtttgccgtacaagtgaatcttcgatgggaactgatacattctggccagaacatggagcatagaagtgattacattagtcatcacactagctgatacatgaaagtgccagtatagtataaggtttacattttggaccttaggttagttcttgacctctaatgtccaggtaaccctccattttagataaatgcttgtttttgtctccatgttttatgtcaacaactggaccatatgaaatctctacttcttaaaaaaaactgtgggggaattttcttccctgtttgtaaagagcgatgcacgtgcaagaactaggcacaaatcggggatatgtgttcttagtggagtaatttctattactaatggtgggtataactggtgtaggaaggtatggatagtacggtaatgaaatgttagttatacatactgacaaacacttttctgattattttaacctggtcatcatgcaagcaagtgtggtgaaaccatttgcaaatagaaaagggggttgactgtgtatggtccatgaattcaaatctgccacacttcatgtattctgcctaaatggacttcatcttctgatgataggtaaacatgttggatttgaatagagctatccttgattcagatgtaagatttatgcagaaaaccgagtgactatttcttttcttcatggaaaagggcagatttattcgaacgtaattcacatttctgaattgcaagcttctccaatgtttatgtagcaccacactgctggattgagagtaattctgcaaaaggaactacggtacagcgacgtaagccagctagggagaattgttctcccgaaggtctgttctgatgcaaatctatgacatgttccttttttggggggtatttgcttcagtacacctcttaataattatgtgaatctttaatgtctattaatgataaaagtgaaccatcttaatcaagaaccagttaggtgaacatcattggtttttggtggcagcatggatggtaaaatcatgtaggatttctggtggcatccaataagaaaatagagaacaaggatcaaaagtgcaaacattagttcttgaataaaatgagcttctcttgacgtgaatagcatgaatatactggtaaatacttggggatgatgaatctgtaaattagcactacttgtcacagatcaaatgtttgtgctataagcagaaagaatatgctgataagtacttggagatgacagatctatataatattatattccctataggttgacagcattaggtctttgttttaaaccatagagatcaaatctaatttttattcagattcatccctttgttagtaaaactaatgtttcttcatattcacaaactcttcttatataggattactgaagcaaacctgtctttttatacacctgacacttgtctctgatgaatgaattcctcagaaagaggcagaggcttacctaccaattctgacatcaaaggatggcaagaaaagtttatgtatgcatgatttgcaaaatgcacaactctggaccttcaagtacaggttgaacagtttgtctatttggctttaaatttgttgttaccatggcttcctctgccaataaccatctgagtcatactttattttcaatgatgcattaatttcaactttattgtatgtatgaattctcttaacgctttgatattaggttgtttcctcttaatgaaatgtattttctttagtgtgtttgcgcctattttgccatatccaacaagaaattagttcttctatattgggtagactttgaaaaataatacggttgcaacatgtatatggattctgttaggaatgttgttgttttatataccatcctcatctctttgaatttactcacatttatttgttgagctttttatgtccttgggaaggtagcaaacctaactctgtacattttgaatgatggtttttttagataatggaataaaattccagcatttgctcacagagctaaaaccaattattacaaaaattgggaacaaaccgatcacatcacaacgaaatatgaaggacacaaccaaactgatagaggcacacaccagcataaaaaaccacaacttattgaattctatttgtgatcctccagccgaagtttgtgaaaagttacataaccattgactcaagatggcgacatgcaacttttattaacttgatatcttcatcacacttttgtagtggaacctaggaccggaccggccaatatgttgcctgaaaagcacctgcatataaaattcagatggtattttatcaaaaactatatcatttatgctcaactatagagtccaacataaagtagatgctcctacaagaatgagtttttttggtttttttatcaaccctcacaagccaatttccaaaaatatgagaaatactatgaggaatatataaaccagaagaaaactgcgatgctctccaaaggaattttgcatagtgacactccaggaaaagatgatggatagtctcatttttcatgcaaaagcaacatctcatactaccattccaattcctcttaccaaattgttctttgtcaaaaccaccccttttaagttttaacaagtaccacataaaaatcttaatcttaagaggcattttaagtttctagataatcttcaaaaaatgtttttttctgttcactaaaaaatgtccccttttttttctgtttatactaaaaaaattttatttccgcagtaagttgcacatgtatagtgtcacaatgaatcatctcctatacaggtattggcccaacaacaagagcaggatgtatgtacttgagaataccggtgagtacctcatttcatttttttcctttttctgttaaacgttatagaacaatgttcttatattccttccctccttttaaacaccaggggattatgtcagaacccatgatcttcaactaggagactccattgtgatatacaaagatgatgagaataaccgatttgtaatcaccttgtctcataattatttaatcaccctactcttttatgctcattacatatgataatttataacttgtgaaggtcatcggagcaaagaaggcaggtgatcaacaagctgccactgtgccacaagttgacgagcatatctctaccctcttccccatttttccaattgcacaagtcgatgactatctctctcccatggcaccacaagttgatatctctgccttcgtgccacatgctgatgagaaccatgagatatttgacgggatactgaattctctgccagagataccagtagccaatgtgaggtattctgacttcttcgacccattcgatgatggtatggacatggcaaacactctgaacgccaacgccaaccagtctgctagtctgcatgtcactgatgataagtctgggcattccttgattcccaacccaaagtctgggcctcacatgtgagactgacagggaagtggtatttcataccatggtcagtttgtatgaagctcagaaaccccttccctggcgccattgttgtacatccaaataattggtgtccttattttgacgctgtatatgctaactgctacatgcagttttatgtgtaaaatattttgttcacaacccaactggaggtttaatcagatgaaacattgtaactctgttcagttcagctcagaaatgtaattgtttctttcagtatgtccattgatttgctggagctagaactgtaggaacctaaagcgccaagtttctttctagatttactggatttactgatcaccaaatcgatcggctgtttggttttccttgctacatgtgaatcatagtacgcacgaagtctttgctccacgcactcctagcctagtagttatgttcttagcattccaaatattgcaaacgctgtgtgttaatttccccttccttcagttcgaatgcgtcatacaccggttagtacatcgaattcaaaagatttaatagagacctgagagcgctgttgctcgtcaattattttcagaaagaaaactggaaatgtgttcgttcatcgcacgagtagtcattttgatggcaaattttggtatagaaaagtaatttcacctgactctttatatggcaaattttgattttactacaacacctttaaaatttatgtaatttgctgataggcataaaaaaatgtcatagttgaagggaaaaaactggtaatttgctaggtgacattttcggatccattggggagagaaaaaaatattaaaaagaggagaatgcgcttaggtccacaagttttgaacgatgttggagtgaaaatattgaaattatgcgactctcattttttgccatcacataaatgcattgttagcatgcatcatattctgtcttcagtcttcactctagtgttatagtctcgtgggttgggaactaatcctccttttatgaaaaacaaaactacggattgccacatgattaattaagtactagctaaaagaactcgaaaatgatttttttagtgaaaattaaaaaatgaagcaatatgattttttaaagcaatttcctatagaaaaacttttcacacgcgcacactcatccctatgaacacacgcacgcaaccctacccctatgagaatgccgttgaatcctggaaaattcgctctcatggaaagtcaaacctagaacataaggtgctattgagactcttgtaaccacta

SEQ ID NO: 755 - DNA, 32441 bp, Oryza sativa; identical to SEQ ID NO: 494

SEQ ID NO: 756 - DNA, 12695 bp, Oryza sativa
attaaaaggcacatgtgttttcgtgagaatgtgaaatcaaagcatgtcgctattgccatgattatcctaagatttcacgctcttgcccgcaaaaactttaacgggctactcacagggaaaatagttggcagatagccacgctttaacgtacgattgccatatatatgaaaaacaaaacaagccatacgcctagccacttgcttttgacatatcccactctggtgtctggacaaggatagaaacaaaccccaccaccattcatgggccgtttgatttatttatttctagcaatggtagattcttttattgggtcggaaaacggatgtgagccactcttgtggtacatgttaacacaactttaactagttcattttagtgatgagattagggatttttcgctggtctccgtctcttcgagtatgtgttaggggcacatccacggttaaatcgagaggttcactccatagaatcaataatatgtacattaggacatactccctccgtcctgcaataaatgaatctagctaggactgaatgtggatgtgacacgttctacatccaagactagctggattggtttttaatgggcgaaggaagtaataagaaccaaaatggttaaagcttgaccatcaatctaagcataagagcaagtataatagtaggctataagccggctaaatgctgaggtggatgagagaagcgggctgtagacttacagccggcttgagcataagaaccaagaaactctgtgagagagacaaatgggtcctatattaattgtaaagagctaactattatataggtaggctgagagaaagctacaaagaaccttatagccaataggtcggctgtattattagccttgctctaatgcagttgccagaaatgtcctaggcgggaatacctggggtgcaaatgggtgaattctttcccaccaattggcgcggtccctctgatctctctttccccataggcggaggccagctaagcggaaaggggccacctggtggtagtgttggggcggggcctcgcccacttgttcctacgcccctttccgcgcgaggaggtgggacgagagacgacggcgatccacggccaatggcgattgccggtctcggtcggtcgcactcgcgctcgcgcgcgggcgcctcgtgggtcgcgggtttcccaggacgggaagtcgctcgcgcggtcgccttctttatttggctacctcctcctcctctcccctccccacccatctcgccctcgtctcgtctcgtctctccactcccccacctcccatccgctactgctagtactactactacccggcctctcgccttctcgcgcggccgcgatttccgttcgcaaatccgcacccacggcggcgcgaggtcgccgtcgtcgtcgagccatttcgggtgagagggggggtctccggtttttctcagatctgtccacttttgtccagttttgatctggtgatttaatatactatttttcacttctggtggtttgcggcgacgcgtgtgcaggggggtagtttataagggcttgcgcgaggagggggaggagtagcgggtagcggcggctcgagtcgagtcgtcgtcgtcgtcggcggcggcggtcgagagagatcgggatcgatggtgcgggggaggacggagctgaagcggattgagaacccgacgagccggcaggtgaccttctccaagcgccggaatggcctcctcaagaaggcgttcgagctctccgtcctctgcgacgccgaggtcgccctcatcgtcttctccccccgcggccgcctctacgagttcgccagcgcccccaggtataccttcttctcgttctcggcaagttctcgccggaaattattctctcgctcgtttcgccctcgtcgtgctgctgcatcaaatgcaaatgcgatttcattctctctctctctctctgtggtaatcgggtgatttttgtggtttggggggtttgaggattcggctgttgggattgcttgttcgtcagagtttgaattcctgcccttaattccgtcgaacaaaaatgggttctctgttcggatttggcacctgcggatttggccaccgctgctgcgacgacgaagacgacggcgacggcgaccgccggccacacacactactagtagcctactagttcgtcttgcttctcacttgctattattgttattattggaagctgtgaactcctgtagaagttgaccccttctctccccctaaatatctgtacggccctggagaccggatggatatgcccacacctcagcactctctcacagtcaccaccagttgcctgtagtatctcttcttcattcatcttcttcttcctctcacatgttaacaactgttccatggagcatgtccacgagctctggattgattctctggcgcgtctctgtgcatcttccttccccattcgtcgattcttgttctcgatccgcgggaaaattgacgattaaaggaggctcctgacctctgaataaaatcaaggacaaaaacgtacaagaaggcagaggtaataaacccaagatagccaatatacaaagaaaaaccaaagtaaatggcagccaatgggaggaaggaggccggccggcgtgcgtggccagtaattgcggggtaggaagaaggctgcgagcctgcgagcgtgcgagactacaaatggagaaacaagctaatgtgacatccggtcagtgagatgagagatcattgggcgcctacctgcaccctctctctctctctctcgatccacaccactgcactgctcccctctcgatcgtacactggctgatgagctagccaagttgatttctctcgcaaaacgtaccacggattggtcgcatcagctccgttcgtcgagggtatggtgtgggggtatctttccatcatacacagtatgacgttggccacagtacatagcatgcgatatggctgtttctgaatattttttcagttttcagcaggtccgaatttgttaggtggaaccgtgatttatatatttctcccctcttccttgtggatatagtactcgtattgtgtatcttactcctagttctcttgcacccactccagctggagagtggagagagtggagagtacgtaccttatctggcgcacactgtactataatccttatattttggtgatcaggtgcaccgtttattatagattaatcatcatctcttagacatggcttgttgcaccttaatatccatctctttatcaggcttatatgtctacggcagtgaaaaagcgttgccagttaattcattgtcgtgcatgtagtttccaaaccatagtctagggaacactcaatgttgttccatgatattaagtgatgttaagtactccataacttaattagtactccatgccaatactcgacaacataatatttccatcacacttcatatatatgtatgctctccctctttctcaattaggaagatctatctagaaaattcttgagtttgcaagctatgatatgcaacgaactttcttctaatgtaagtgcaaaactatggattgtcattcattacttacgttacttcttaataaacattatcaagaagctagattgtagagcatgtaaagctgagtggaaaaggagttttggtaagcatgtgattgacatgtcttataggtcgtcgattgatctgcccaaacaacagtacaaatgaagttaattctactgtgaatagcatgtgataactcgcaatccgtagaatgctttggctttaaaacaataattttaagagtgtgagcaatgcttatgttacttcatcagattatcgtgtgccttaattcttatctgttgatcatatttagtactcctcctacccataaatatatgaacacttgaagcatttaaaatttatccacaaatatgatgattattcctagagtactactgatccctcttcccaaaataagtgaccaatttggatgtaaaatttgtttcaagataagtgatcacattacagtgctacttgtctattaatcacctcttgttcaaacttcttatcttacctcaactaccctcccacttctaaacatccctcatttaggtcatttgcctttcctcattatttggctcatatataagtgataaagtagcttattcatttattttagaacagatcgatggagtacttattacaacaatcacccgtcattcaaatttctttctaacttacactcaaccaccgtcccacctccatctctctatcttctcctccaactctctctcttttaatgaggggcaccaaaatattttcttctcaactttaatctctactaaacaatttggcatgtgtatatttgttaatggagggagtattttctaagttctaagtacttgatatatatcgtttaaccagaaatctatacctatgtgaaaaaaatacattgtccatagatcgatctttcatgagtatattactgaatcatgccaaatttggccaatgttacatattaattatgatcttaaagtttgttctgaaattactttgccttgaatcttccaagcaagtatatatatacgtgtaggcaccacacttctcatggtcaaatttagatatttatcaacctaattagtcagtccatatatagagagttaatgcaactagctagttgctttgtctaatgtgagatcttttgtacgtgaactgtaaacattatatatacaacctccatcctatattacttgtcgctttgagtttttatttgtaatgtttgatcattcgtcttattcaaaaattttttacaattgttatttattttatttgtgatttgctttattatcaaaagtattttaaatatgacttatcttttttatatttgcactaatttttcaaataaaacaaagggtcaaacgttgtaacgaaaaagtcaaagcgacatctattatgagacggaggtagtatgatcggtgtgctgtctttagtcctgtttaagatacttaatttctctgaaatacaattgctcataattacagtgttgttgtcagttttgtcttcttttccaaatactttatttgaaatatggataaatcaaacttaccttttaccctaataaactacactatacatactaatcttaataacatttatgcataacatttatggtttttgttcattcttttcaaatccgttccattctgggcagaatggggcaatgcaagtactgtcacaaagaacaaagaacagatggtgcagccggatatgcatatatatataccagctgaatttttggccgtttcaggaaaacttcaatttaaaatcaatgttggtactatcaaattaatagctgcaaagtctccactaggtctagcaagaaagtagcagctcaatggtagtaataacttcatatgtttatcgaacagatattagctttctttaaaagtccattaccaaacaaggcttatctaggggcatagtacccccatagacccatatgtaggagtaacaaagagaaaatgattaattacaaatattttaatgggcttgtttggcagggctccaactctaagtactagctaaattctgttctacctctctagttcattttataaaagcactctagcattctcctctctctttgtaggtggagctgaaaccgtttggttgggctctagctcaaggagaggtggagttggagctttgccgtatgggcccaatgtatataaaaaatatctataatttggttatagagtatttgtatttcaatgggaaaaaggtatatgtgttaatagtattatactcttctcataaaaatgagtgtgaaactaacttttgtaataatccttactattagttagctgagctcgaactattctttagtgtacaggcaacacgccccaattctacaagtgctgcaaccaaagctttcaatactggttttgccggaaatacccgtaccgcttgctggttgttacttcttccgtttcataatgtaagtcattctaacattgcccacattcatacaaatgttaatgaatctagacataaacatatgactagattcattaacatctatatgaatgtgggcaatgctagaatgacttacgttatgaaatggagggagtattagacaaatgttcaaatctaaaattttgaactcactgtggttcagtaacctgcaggcagagaaaaacagcatgattgaaagcacagttttgcataaacaatacatcgcaagtagatgaaaactattaaaacataatcatcaataatgatctgaccagtctaaaaaaatcaataatgatacgcatcaatagatataagtccatcatgaacaatcataatgcaataatccatcacaaaacccctacatagggcataccacaatattattccttctcaaattgtaattcaaggtataacacaatttcacagcacacataaatatcttattgatcttttctctctttccattagagatgtacctacagataacccttcaaagtgaagataaattcatatataaattttcaaatatgtttttctagattttcaaattataaaataaactgtcccaggcagttactagacgttgagatttctaacatggttgtgccatcaatggctgtttaatttctgtacatattacataacatatagtagggttgtcaatgagctgaacttgagcacatggcacatcaatttcgttttcaagttgaatgaatgatctaaattgaccttgagtgaacctgagttggtgccaacaaccgatgttgaaggtatgctcttgctaaaatttaattgaaaacttgagctttagcccgataaggtcacacgaactctatttatgcatgtctgaatgtgtttcatgcaaaaaagaaaaggcatggccaataatttcgaatccataaggcttgttagcttacatgtgttatccttcaatgaaaattatattctatattggacaaggtttcgattcttgttggtttatatggttgaaacttttatgcttggaacaattcctacctgatgaatcttgttattattcccaaagaatagccaaatacaatatatttgtttctactatataacaactacattttggcaagtcaataatttttttttgcgaggaggctagtcaataattaagtaggcacactcctatgcacgccaatcagattatgttgattcagaaacatgcatgcgcactgcacataagattgctcattgaggtagttgcattatttatttagctaagatattgccagcatggcaatgaagcagatatgatgaaaatggaggatccagaatatatatcctcagcttttttttccaattatcaaaaagtttaaaccatcactaggaagagtgaagctcttgcattgttcatttaattaggtggacaacagaaggaacagttcagtttcataatatatagcggtcaagaaaaagtttcatattatatataatacatgtgattttgcgacttgatacatttatcgtagtatccattattcttgttaaactgagcctgccctgcctatggaatgattacctgaaatattattttagtggaactcagttatgccttttatattttattaaaaagatagaatttgagtttgtgtcccaattttttgttaccaggaaagattctaaaaaaactcaaaagatgttgactatctaatctttttgaacaagatagatacttagaaccaaatttacacaaagaataaagcattttaaaatgtaatacaagtagatgtatttcctagtctggtttgaactgcatacaaaaacaaaattgctccaaaggatgtctgtcatactggcaaatgtagacatgcttcttgaaaaagttggctcaaagatggtcaattatgcaatgtttttttttcaaataaatatatattttttaacatatgtactgaaattgaacgttttgtgatatacacagaacatgcaccagtttaacttgcagtcctgaattttattgatgtttaagtgcttgcgttcacttattggtaactatagaacgtccatgcatgtgctatcgtgtgtacagcttgggatgtaacatctgaattatgatataataaatatctaggaaggtaacaaaatgttcctcgctagtgctggtgttgatatattttcagagaaagctggaagcgcaactgtcaaatcaacagccgcctattggcattgaaacatacatatctacctctcgttgtttctacttttttttggcaagaatttggttggatatagttggccataggcctgtagccaccactgtttgtagcatcgcaatatgcacagacaaacatttgagctgctgagctagcagagctagctagtttattgtagcaggttggaacaagcacagctagctcaagtcatgcatgcactaataaattagagtatgtatgttttttgccccagaacgattatatcatcgatcttctgatttttagtttgctccttgtgtctgttctgcagcctacagaaaaccatcgaccgctataaagcatacacaaaggatcatgtcaacaataagacaattcaacaagatatccaggtgaatatcttgcctccacacacaatccgcatatatcatgcaacatatgaaaactatttccttctttttatgttgacgagttcttgcgtgatgcagaaggtactgcaatttagcaattaatggcacaattttatattgctgacttttaactttctggcatgcattttaacgtagcaatggcgtgtttgttaatatagctctagactctaggattacaagaaaacagaatgtccctagctctctagacttggcggttgggcaacagaataattagccttggtggttttcagtctatacttggcggttttcgaccgccaagaacattctgttttcttgtagtgtggtgtggtacattttgcggcatcttcagtttttttttttgaaagttgcatcttcagttattagtgctagcttagctaagagaacatactgcagttaatttagcaataaaagtacaaagtaccaaacacattgtaaagtagcgctacatgtaacatgttcatcagctgatcggttgttgggagtcctattaatttgccattggtatgtctattaattaaactagatgaataccccgccgcgttgctgcgggaaattaagttacataatatgtacatatatgatgcaatataattattaaaactaaacaaattggtacttatgaattttgagcctataaataattgagattgcatggtgttatgagagaagaaagaagagacaatttgaaccatagatctatcatccaaaggctagaaataattgggatgatgtggcttaatgagagaagagagaaatagtaataactacacttagtgtggatgaactatataagtagggatgaaaacggtcggaaacgatcggaaaacaacctcaaccatttccataatcatatttttctcggaaatgaaatcaaaaacggtaaagtcggaaacgaaaatgatatcggaaatatcggaaaaccggaaacggaataatacggacggaaacatgtcggtacagatcggaaaccggtaacaaatacgaaaacgttaaactatagaaaacatatataagtatgttatatgtacaaataaattcaagctatactatataaattataaattaactccattttagccatgcactcaagttagggatttgattgaagaatcaatcaatctctaaactgtgggtcaagtagagacgtgccctttagatatcaacatatttagaaatacggtaattaccacattataagaaacggtaattttcataagaatacggtaaatatggaaacgatcggtacaacagcaaaatcatttccgtttccattttcatattttttaccatttccatatggctcggccggtagaaagtcggaaacgaacgctagtcggccgggaatttccgttaccgttttcacccctatatataagtaaataggatgcctgcatcctagtatcctacactttagcaccttcaattaattaattgttgcaggtaacttcttattaagatgaaaaataattattatctgcatgagacttagctgaatcaatattttcctagttaactcatatgtgccaaattccatttgtaatttcaccaaaaaacatgtgcggtataaaaatgtatagaagtattgaagtacttcaatattttttggggcatattcttgagtatagtactatagcatgtgaacatgcacgttctaatttctaaggttgaatcatatatactgcagcaagtcaaagatgatactttaggcttggccaagaaacttgaagctcttgatgagtccagacggtaagcaatcgtgtctctttctgaggagtatgattacatgataatcctgagagccaaaaaaaaaaatcagtagttcactctgaattacatgtgatgcaggaaaatattgggagaaaatttagaaggattctctattgaagaactgcgtggtctagaaatgaaacttgagaagagcctccacaagataagactaaagaaggtttatattagctattttcagtactcctaatggccatgagaaaattgaaggcaaactttttagaaactatgaataatcttctgtttacagaaattattaacacgcattcttctatattatctattcgttaacactagaccgagcttctggagcagcagatagccaagctgaaagagaaggtatacagccgcaatcaatgcatattcctattccctatagcaatacatcaaactccatatatttttttccctaactctggatgttatttttttccttgcatctctctgatattaggagcggactttgcttaaagacaacgaaaatttacgcggaaaggtaatcaatgattatgaacaaccgcctgttatcaggcaaaacaacatatactgcaaactacctttttcttcttttatccagtaaagctgcacgtacagagtatatctgatatctcatgcatgtgctgatgtgcagcctaattatattatccaaataaccagattgatatatgacccatcaaccacaccattatttacatgtgcaattgattcatttttacaacaaacttaggctgtgtgacttatggcagaatctgagatataaacaatttccattaattatcttgagaaaatgtgcaattgatctctgcagcatcgcaaccttgaggctgcggcgctggtggctaaccacatgacgacgacgacggcgccggcggcgtggccgcgggacgtgcctatgacgagcagcacagccggcgccgccgacgccatggacgtggagactgatctgtacattggattgcccggcactgagcgctcctccaaccggtcggagacaggttgaagaaggccagccacagcaacagctgctatatagcatgcagtagcagcaacgacgccagtgacatcctgttcatctcacaagaataaccagagctctacgcatgcgcacatgaaacccaggcatgcagttctcggtgggtaaattattatctcgcattattagctatatgcgtgtccttgtctttttctttaggcaatggaataaaatttccggtaagtacaaacacaaacggaaacaaagaattaacaaagctgtagcagaccagatcggcaaattgaaatgccaggtaatccagtatatatttcgcttccagctgcctctaccctcatatctcacctgcctgtgtgtttgtgtaaattgagcttgcgaaagaggaaggtagatgctgttaatttatgggagtggaagctaaatgttgtactactggagtactgatttgtagctgatccaactgccacgagttttgggcgtcgaaattcctagacttcttgacaccgatggatggaaattatgccgacctggcgacatgatccttaagtggtgtttgaatctcgattaagataaagattaagtgtttcacgcaaaacgacaaaacgaggtggtaataacatgtgattatttgagttttaattattacaaacttgaaaaatgaattaatctgatattttagagcaattttcatatagaaaatttttgcacgaaacacatcgtttagcaatttgaaaagcgtgccacgagtatccaaaatttcattcaactcttgtcagagaaacgaacccaacctaatttcggccatcgagatttgaatattcgataaggtggtatggttgtactccctccgtcccataaaaaactaacctagtactagatgtgacatatcctagaataataaatctagacagattcgttgtagtagaatatgtcacaaccagtcctagatttactttttttttggatggaaggagtaggtgtttgccgccgaacagaattgcagctttgttacttctgagttcagacgtctgatcctgtctgcattgcagcgaatgggttaatctgggccttcgaacaaagcttggcccaatgttaataaagccccttttctcgatggaatactgggaccaagtaaatcctactaacggatgatgctagtttaagaaaaagtctattttcgttcctcaactatagcccaggccattctttctttctcttttttcatttttaaaaaacagccccattctaatttttatcctagctccaactgcaaaaccatttatatgaagacttcctcaatcataggtggttttgtcttacctaacatgttg

SEQ ID NO: 757 - DNA, 10170 bp, Oryza sativa
acaatttactcaaacacattttaaaagagggttttgacagctggttctttatctaacgatccatttattggacgttcatgtttgctttaagattctgcacaatcttataccaaatcccctactctccccccccgatccccaacactaccattatcacttagcggcacctcctttcactccatctcttgtcaagcatcggtgttggcgtcgcaggccatgaacttttcttccccattctccttctcatcattctccatcaccaccaatctttatcaacttcgacaacttcccctaccccctctctttttacctatggtggctcttgtcaccatatccacattcctgtcctaaccacatggatgttcgttttcctgccaccatcctcctctaatccttatggctatggtgacaatgttacctcatcatccatccgtctctgccatacaccctagtcccccacccgacgttttatccaaagcaaccgccatggtgtcttactcctctcccatcatcaccaacatatataataaatatctaatttatcaacaaagtttgctaaatttggatgtcatctgcattgtgggctcgctggtgagtcttcgtcatccgctcctctcacatgttctgccaatggatcaactagtttttatcagacttaggtggtgtttggatctcctaaagatgaagatgaatataaagattaagtgtttcacgcaaaataaggtgctaataacgtgtgattaattgaattttaattttttcgcacgaaacacaccatttagcagtttgaaaagcgtgtcatgaaaatctccatcttcatccaaacaaacgggacctagcaaaggttacgttgctgcatccgttactccgttagggttggggaatttggtccaatcgacccgaaccgagccgtacgtgatccaacaaaatccaaaaaaaaaaaaaaaagattcacggcgacctccgctttagcctgcccaatcccagttcgtcgtcatcttcagagcgagtgtactcctcttgccttctatctatcccctgatccctccccctccctttccagccaccgcatcgcatcgcatcgtcatcgcgactcatctcgccttaacgcagcagcaagccaacgcgactgtgtgcaatcccactctcatctccctcagttactgccttgctccccaaccccaggagcaagcacaagtccactgcgtgcgtgcgagcgatgactccgataaccgcaggggcggtgaggtgaggtgaggcgaggaaaaaatcggacgcacccgcctaatccggaccaatccaccgcatcggcgccatggcctcgggtagccgcgccacgcccacgcgctccccctcctccgcgcggcccgcggcgccgcggcaccagcaccaccactcgcagtcctcgggcgggagcacgtcccgcgcgggagggggtggcgggggcgggggagggggagggggcggcgcggccgccgcggagtcggtgtccaaggccgtggcgcagtacaccctggacgcgcgcctccacgccgtgttcgagcagtcgggcgcgtcgggccgcagcttcgactacacgcagtcgctgcgtgcgtcgcccaccccgtcctccgagcagcagatcgccgcctacctctcccgcatccagcgcggcgggcacatacagcccttcggctgcacgctcgccgtcgccgacgactcctccttccgcctcctcgcctactccgagaacaccgccgacctgctcgacctgtcgccccaccactccgtcccctcgctcgactcctccgcggtgcctccccccgtctcgctcggcgcagacgcgcgcctccttttcgccccctcgtccgccgtcctcctcgagcgcgccttcgccgcgcgcgagatctcgctgctcaacccgctctggatccactccagggtctcctctaaacccttctacgccatcctccaccgcatcgatgtcggcgtcgtcatcgacctcgagcccgcccgcaccgaggatcctgcactctccatcgctggcgcagtccagtctcagaagctcgcggtccgtgccatctcccgcctccaggcgcttcccggcggtgacgtcaagctcctttgcgacaccgttgttgagtatgttagagagctcacaggttatgaccgcgttatggtgtacaggttccatgaggatgagcatggagaagtcgttgccgagagccggcgcaataaccttgagccctacatcgggttgcattatcctgctacagatatcccacaggcatcacgcttcctgttccggcagaaccgtgtgcggatgattgctgattgccatgctgcgccggtgagggtcatccaggatcctgcactaacacagccgctgtgcttggttgggtccacgctgcgttcgccgcatggttgccatgcgcagtatatggcgaacatgggttccattgcatctcttgttatggcagtgatcattagtagtggtggggatgatgatcataacatttcacggggcagcatcccgtcggcgatgaagttgtgggggttggtagtatgccaccacacatctccacggtgcatccctttcccactacggtatgcatgcgagttcctcatgcaagcctttgggttgcagctcaacatggagttgcagcttgcacaccaactgtcagagaaacacattctgcggacgcagacactgctgtgtgatatgctactccgggattcaccaactggcattgtcacacaaagccccagcatcatggaccttgtgaagtgtgatggtgctgctctgtattaccatgggaagtactaccctcttggtgtcactcccacagaagttcagattaaggacatcatcgagtggttgactatgtgccatggagactccacagggctcagcacagatagccttgctgatgcaggctaccctggtgctgctgcactaggagatgcagtgagtggaatggcggtagcatatatcacgccaagtgattatttgttttggttccggtcacacacagctaaggagataaagtggggtggtgcaaagcatcatccagaggataaggatgatggacaacgaatgcatccacgatcatcgttcaaggcatttcttgaagttgtgaagagtaggagcttaccatgggagaatgcggagatggatgcaatacattccttgcagctcatattgcgggactctttcagagattctgcagagggcacaagtaactcaaaagccatagtgaatggccaggttcagcttggggagctagaattacggggaatagatgagcttagctcggtagcaagggagatggttcggttgatcgagacagcaacagtacccatctttgcagtagatactgatggatgtataaatggttggaatgcaaaggttgctgagctgacaggcctctctgttgaggaagcaatgggcaaatcattggtaaatgatctcatcttcaaggaatctgaggaaacagtaaacaagctactctcacgagctttaagaggtacctctcttgtcatgctaattggttgttcttgcctttcatgttttcttttgcgaatatacacaatactgtttactcgatattctttaattacttggatccctaacctgtaatgctaatttggttcctcttgcctttcatgtttcatatggatagtgcacacaatactgtttactcgatattctttaatgacttgacatttagacacatttgataatttacaacagtgcccaaaactgacaaagtatattgagctcattcagtaggtacatgtaaggctggaatactagttatattattctaaattacttattcaatacaccacagtgagtttatgttttcactaaggggaagtggtaggactgggttcatgatttgttaatttgttgctcatgcaggtgatgaagacaaaaatgtagagataaagttgaagacattcgggccagaacaatctaaaggaccaatattcgttattgtgaatgcttgttctagcagggattacactaaaaatattgttggtgtttgttttgttggccaagatgtcacaggacaaaaggtggtcatggataaatttatcaacatacaaggggattacaaggctatcgtacacaaccctaatcctctcatacccccaatatttgcttcagatgagaatacttgttgttcggagtggaacacagcaatggaaaaactcacaggatggtcaagaggggaagttgttggtaagcttctggtcggtgaggtctttggtaattgttgtcgactcaagggcccagatgcattaacgaaattcatgattgtcctacacaacgctataggaggacaggattgtgaaaagttccccttttcattttttgacaagaatgggaaatacgtgcaggccttattgactgcaaacacgaggagcagaatggatggtgaggccataggagccttctgtttcttgcagattgcaagtcctgaattacagcaagcctttgagattcagagacaccatgaaaagaagtgttatgcaaggatgaaggaattggcttacatttaccaggaaataaagaatcctctcaacggtatccgatttacaaactcgttattggagatgactgatctaaaggatgaccagaggcagtttcttgaaaccagcactgcttgtgagaaacagatgtccaaaattgttaaggatgctagcctccaaagtattgaggatgggttagtattctgaacttacctttttctttaactttaatgaatactgatccacactaatgtctctgtgtttgggataacatctgagaatggcatatgatatcccgttgtgctcttgaaaaaatgtatgttttgtgatcctctcctttctttaccttgtgctaagactaggtgttgtttggtgtttcagttggcactaaccgttaacctaagcatggatggaaaataaggaattagagaagtccgtcagactgacagctctggttcactgtattcatttatctgaaaagttctcttgccatgtaaattttatccttttttagattaatgcctgtattctgtgcatgtgggccttttatgggaatttagtttactgtcagaacccttcttgtcattgcagaaatgaactaaaactagttgcccaagtgtagatatcaagcataaaattcatgctaatatctatattgctagtatcctaagtacattgccgtcctcaacagcttaaccttttggccaaaatggttgttgcatgaaagtcgacatcaagcagcttactctaaaaatgccattgccaccctttactcttgtttcataaatatggtaactatttcttgtaaatgctgctgtacactttacttgtttgaaattttggagatcattctggtttccttgcatcacttgatcaattcctctcagctgcatttattgacaatgaatgtgcaatgcttttatcctgaggaagtcactactccctctggttccataattcttggtgttttggacaatgacacggtctccgaaatatatctttgagtatatttttctattataatacttcctccgtcccaaattaagttaatatagtacgggatgtgacatatcctagtagtaccaaagtccaagcatagcctaatctagcatagttccaaataggaactcatggctctgtgatgtatttttcttgtgtcatttacttggtgtaatttcattctaggtagaagcattgtgtgactttttcgtgtgctgagacatttgaactcactgctaaatttgacgccttattagtattttaacaaatgattagctgaaagcttatttgttttttgtgtttattaagcagctctttggtgcttgagaaaggtgaattttcactaggtagtgttatgaatgctgttgtcagccaagtgatgatacagttgagagaaagagatttacaacttattcgagatatccctgatgaaattaaagaagcctcagcatatggtgaccaatatagaattcaacaagttttatgtgactttttgctaagcatggtgaggtttgctccagctgaaaatggctgggtggagatacaggtcagaccaaatataaaacaaaattctgatggaacagacacaatgcttttcctcttcaggttagctatttatcttcattttcaataccagaaggcaatacatattctcacgcaggaatttcttgtgttgaatttggtagaggacaagttaaatatttggttaaatttatattcgttggtcatatttgctgtagcactctaggtaatatttgtgtttatcctgaactattgatgctctacctacagacactacaaaaaatagattatcctaaataagatctcctacatatcaaacatatgtattatccctgtacatatctgatagactgaagaccccacctatttaagtataaatatatgcaaaatatatgtgtcatgggttggctggtcactctctttgagtaaatttggaagataataaaatacacttggtttattttctttgagtaagtgacataaaacgctaggttttggggccttagtaacacaaacccccaagttttgcaatttgtgtcaaagaacccaaggctttgaggcaaaatgctttataaagccctagatttatatacaaaacacttacacgccattataatgaaccaaatttcaactgtatacttacatagatacgcattcctaatcctaccgtgtagtctatttccttccccactctcctactgaatgaatacacaatggcaaactccagttacaaagaccagggccgtctccaggatatgggggccccagaacaaaatgcaaattgagaccctaaatttttaaaaaataatgtgtcattttcagttattatataactttaatatgtgttatttcgtatgatatttagtacttcctccgtttcaggttataagactttctagcattgcccacattcataaatatgttaatgaatctagacatatatatatgtcaagattcattaacatatatatgaatatgggcaatgctagaaagtcttataacctaaaacggaggtagtaatatattttcaaatattaatggtacaagagtaaaggtagtactaaccttatgttccagtgtaaagcatcatctgctgaggatttgaggacttcctgttttataaaaagggagaagacgttcacattacttttgattcgataattatcaatccaatggaatgatggatcattcaaaatactgtaacagtgtaacttcattagccttgattcaaattagtaatcagtaaattatcgattccgagtaccaactagagctaggcctcgcagcctcgtcgccgctcgccgttcccattgctccgcttggcaacatcggcgttgtgctgcctgctgccgtgaggcgtaatgctgtcgctgccgcctgctgtgctgcacacacgcagcaagtcgcgtctctccacgagtgaacactaaaaagtaaacagttaagacggagcgacatatgtcttccgcctgggcacctagcgtagctcctgatctagggccaggctgcaggcctactccgaggcgggggcccccaaaaatagggggccttgtgcggccgccgtgctcgcacatggccttagacggccctgacaaagacatgttaactgggtacataaatgcacaaacagtcatgccgtcaacatcgatacttgtcgagtaggcggctaatgcacaaacagtcaaggtactactgaaaaaactaccacatactattttgtacagctattatgcataaattccatagctagctggttgatgttgacacaaaatggggttctgtgaaacatttgggcccaaaacctgggttagttgaaataaattgcaaaatctgggttcttatgttactagtaccacactaccactaaaactgcagatttatgaaatctaccttatgtataattaagcctcctaggctcttaggaactgctgctaacaaaatagtagagatatgataggattttgacaataggtaacaaatactaagaacaaggaaactagagatggtatgatcaattaaacttggtccttatctgttgaagatggtgttggaactttatcttagtgatgccagctaggaagccctcatacctgctgctaggtgctacagtacgctactgttcaccggtgtccatggctagcacaccctcatggttccccccccctccaaaaaaaaaaaagattagttattacagcatgtaccttcgttgtaatggtgttgtaaataataaaatatcaacaattatttcttggtgttggagtattaaacgtgtgacactggtcaccaaggtgaatgatgcttaaaatttggaattttttaattgtctgcactagttcgtgttgttacttatagtatagagaacctaatgactcggcagggaggaccacaaactgatcgcttaccatctatctggttctgcaggtttgcctgtcctggcgaaggccttcccccagagattgttcaagacatgtttagtaactcccgctggacaacccaagagggtattggcctaagcatatgcaggaagatcctaaaattgatgggtggcgaggtccaatatataagggagtcggagcggagtttcttccatatcgtacttgagctgccccagcctcagcaagcagcaagtagggggacaagctgatatggtgtatgctcgtcgctaacctcgcataactattcggtcaaccaggtgacctgggatcttctgatggagaacccagtttatgagagttccagaaaccaacatttcgtccactctgatgaagcacatctgaactttggaacggcatcggtgattctcggtgtcgaggtggtccctccagtctcctgattcctggcatgcccgactgtaagttcagctttggacgatgttgttctattagagttctatggcggcaagcaatgcacactgacggtcatgtaactcgtagcataggcccactaccacttggttgaagtacatatatgttctaaaagctgccatgtatataacatcggttatatatgtactacgtgcataaggagagctgtgcagctcccagggtggtattttgtagggcttcccaagcctatgacatcttattatatcatcttaacataaaagcatttggtttccttggatgtcggcatctactcgattccccaattctgttgtgcagagtattgtcctgatgtcttcctatgaatctcttgctatttttatcctgccgtcgctcgagcgtgtgcaacccgatgtcttcctgtgccgtttgcctgtccggctcgtgtatggtgagaccgtgagattggctgctgaaacgctgggccggtgcgcatcagcgcatgagccgcaacctgcgggcctaggtgacgtacggctttcgactgatcagataaacgataaacggagaggagaaacggttgggagttgggacacaggttccgtatcgttttctagctcgcctctccctgcaccaacagcgctgtttattgctcggcaatagtttgttcaggactgtcgactaagttgcaagaccaatgaacagccggtacgaagaggagtgcagaatcgtattttacagcttgtatatgtacatgcacatgccatctgccatctggtggttccatgcttgatgcttccatacagttacaaatgttaacttgtgtatagattatcgtagtcgtaggtaggctccatcaaaatgcaaaccgaagatttaggccctgtggtgtttttctagactgccgatgcagttccataggaggactacctgttcggatttatatattaaaaaaaagaactgtagaaatttcataagaacaaccattcgaatcacttgaggtatctggtaaaacaatatgtttcaaataaaatcgaaaccactgacatatgcttgaatgcttgacagtgcattcacaaccaaaaatagaacattattaagaccggggggggggggggtccatataggtagaatatgtagaaagtgactgtaaatatgcttagggtgtgtttagttcacgtcaaaattgaaagtttaattgaaattggaatgatgtgacggaaaagttgaaagtttgtgtgtgtaggaaaattttgatgtgatggaaaagttagaagtttaaagaaaaagtttgaactaaaccaggcgt

SEQ ID NO: 758 - DNA, 4725 bp, Oryza sativa
gcgagaagttttatctctttaataccctttacctacctatcactcttacagcttttttcaatgattaagggcattttagtcattcttcatctccactaactccacctcgggatgctaggaatggatttttttttttgggacggagggagtatgtcattttgaaacagagggagtaccaaaccaggctggcaagtagtactgactacagacgatattgcccgaagcgtaaatcctatcctagtcagcacacatgaagaaaagtctacattgcagagctgaagaatttgctgtacaacttttaacaggtgcctagtatgcatatgcattttttttaaacacaggttggtttgcttgcaagatacgcggctttggcccatctttcaactaaaagttatatttcaatggaaaataacatgaagttaactgaataagtgaagataatttcgtctgaaaaactgaaaacaatttgaagcacaaaaaaagaagtatcctgaaatgctaagcaggagaaaatttcccaaaaacaagcattgaatggaacagctaggagattccactacttcagctaggtgtcaagcaattatcatggcattagaatggaaccggaaaatgtcacaagctgtacttggctccactacctctacttggctagttgctcaaagtgtcaagtaggcatgatggcattacaccagaacagaggaatgcataaagctgtacttggctccactacttatggaaatatagaaagtttttttaatggctcaattaaggagaacatatgatctttaaacattgaaatgacatctgagcactagacagcacccctacacattgaagtggtggcagcactgcgttcccttcctttattctcttccatggtgttttgccatagtcctccaaagaagagaataaacagataataatggtaatccaagtagtatcacagtttggggaaagaatctaacagcaattaaactcatcaaattctcttttccttatcagaaaaagaggacgctgaatggggcttacctaaataaacaaggtgtgcaaagatgaacatttgagggcgcagacacttccacgcaggtggtgaagcatttttttctgctagataacaaaaagaataattagaaaataagaagataagaatatcaagcaaggcaagctttaatgtttaacaagtaatcaccaaatcgaacacgcaaaaaatgaattgatagttttggcaaataagaatcacttgaaagtgctaagattccttttttttttcttttgccctataagggcatggttcccaatttttcacaaaaaaactccatcaagatgttaacatttcatattaaatttttttaattgccctctccaaaaactagatgttactgtaatgccattataaatgttacagagtaatttctgtttttcatttagaaaaccataggatgatacataaaaataatcataacatgctaaagagtatattgtcatgcagactctgcagatcggcagacaggaggacgaacactgtttattgaccgataagattgctcagcaacgtaatcttcatagatccacttgcctcaaggtttcttatgtttcagaggaatagcataaatctagtgatctataatattttttgagtaaactactgtggacaaactatcaaactatcagcttgaaagaaaaaatcatatcatgaaaaaaaataatggtcttctactgacaaaatgtttgtattaataaccaaaaagaaaggacctgaaaagaggtgtattaacacctccagagagttcaatagcactggtgacttgcatctttcccacgcaaacagttcttttaagggggaaaaaaacaaatgcagagggattatccttagaacttgatggaagatacatgaagtacagcgtcagcgtgtatagattctattgcaaactgttatagaagaaaataagacccttggttggttatgctgcaaaagttgttagctactttctgtagccttttcagttattttccacggcatacctgactaaaaaacacacatactactcatgtctcacattgtccattgaggttgcaagacacttgaccagcaggctgctggccactataaatagaggctcgtactaccattgccaagcaatcagcccacagctcaccgaagtgcattagctcaccacgactagctagagcactcattggtgtgcaaaatattactgtctgctcctctaaacatgtctaggtctgtggagcctcttgttgtagggcgcgtgattggggaagttcttgatacctttaacccatgcatgaagatgatagtgacctataactccaacaagcttgtatttaatggtcatgagctctacccatcagcagttgtgtctaaaccaagagttgaggtccaagggggtgacctgcgatctttcttcacattggtgcggagcactcaacttcatagttggtttacgatttttttccctggttaaccataactcctcatgtttcaggttatgacagacccagatgtgccaggaccaagtgatccttatctaagggagcaccttcattggtaaccaaccatgaacatttgtatctaaatactatatatttgtttcttgtgggtggttaccgattagctagacatgttagttatgtttctagggaagataggacaattactttagctttcatatgcatacaaacaacacataatctgactagtcttaacatgaatagtaatgtggctaaattatcagcaaatctcaccttaacatttacgcaggattgttactgatatacctgggacaacggatgcttcttttggtaggtccttcctctaatttgtgtcagtttttttttccatcttattcattgagtttctccttgtgaataaacaactgtaccactttccgattgaaggacgcgaggtcataagctatgagagtccaaagccgaacattggcatccataggttcatttttgtgctcttcaagcagaagcgcaggcaaactgtaattgtgccatccttcagggaccatttcaacacccgccggttcgccgaggagaatgatcttggccttcctgtggctgctgtctacttcaatgcccagagagagactgcagccaggaggcgctgagaaatgcagctccaattgtcccaaaattacgattctctgaaatcaaaccttttctgccatattactttctcatgaatcaacgttcttctgctacatcagcagccagtatatctgcgaataaaccagatgcattttgcagcatgtattagtattagatttctttccgtatcaagaacatattagtggattattttgtaagcagtaagattgatagccatgttggcaaattccagtgcactaatatgtaaaccacgttattattaatgtttttaagtcatgtataagccaattcatgctggtggacaaacccaactggtagaaagggctttttatctatttgtatgtcgcttggtggctccacatggtgtcgcttggtggctccacattgcatactactattcaggttattaacttgtagtaataagtgacacggggaaaaagtgcagtagtaagtaacagcaatgatatgataggaatccagttttatttttgtacaaaaatcatccacattgcatactagtagtactatgcaggttattaacatgtagtatgtgacacaatggaaaaaaatgcagtaagtaacaacactgatatgatgggaatccagctttctttttttgtacaaattcatccagattgcatactactatgcaggttattatttattaacatgtagtagtaagtaacacataaaatcggctgcgtacatccggatggatttagaggcccggtttatcccattttcttaaaaaaaaaattgcagtaaaagacaacactgatatagtgatgatatggtgggaatttgtagcacaatcctttgaatgatccacgaattcccgcacaaactgaaacgcgcgagtggaattaagtgaaaaaaaaattactggatcccagcggcggcttgcggaatcaaagcgaagcaagagagagcatatcgtcagagagggaggggagaacaaaaccctcaccaggctcgcggcgggccccgtacgtcccgccggaagcgatcgctggacggaggaggccctcaccggcggcggtggagaggggggggggcgtcctcctcgccgtcgcagggcagccgctgccgccctggcggtggcggcgccatcgccggcgacctcgccgaggatgtgcggcgagtgggctgacgacgccgcgtacacaccgtagccgtatttctacgagtatttttagtgggcccagatggccgtaatccgttacccaggcctctcgttagatagggcaataagttcatctgaggtcccttaacttgtcaacgaattcggttttcgtccttgaacccaaaaccagatataacgggtctctcaactattaaaaccggtgcagataaggtccctcggcggtttagattgtggttttggctgacgtggcgcctacgtggcgaatttgactcggtcttcatctgacgtggcattgatgtggtgcttacgtggcacttcgacccaaaaaataataataaaccccgtggggcccacatatcagtttcgtatacaaattaataaaaatggtgggacccacgtgggccccacaagtcattctcacccctgatcttcttcctcttgatctc

SEQ ID NO: 759 - DNA, 3769 bp, Oryza sativa
ttggaatcggaaatataccgaacacaccgcgaattgtagaataggtatggtgaaaaattaatgagagatgaagcttgtaaaacgttaggccagctataagttttgccatgccagatcagctacagtaccatctgattctatcgtaacaatagaatctacattgtaccctagagtatgtaatttaattgtgcacaacaatattagtagctatagggcctgtttgggggagcttctagctgcatcaacttctcccagaatcaaaagctctcaaaatagttcagctgttggtccagattctaaaaagctatagttatagaatttataaaagaactaaaagccagaagctaggtaaccagcttttccaaactctcagagcctggttaccaaacagctgttcttaactctgccaaacatgcccatagttagcttcattattttactgctagcttcatttattttggacggggttagtacatatgtatctgtctcgaaatcgcctctgtaaatggggtcagtttcagcacttctatcgacatgaagaagatagaaagggccatgcgagagagagtgtgtgagaaagagaagattctaccgggcacaacaaagtgtgtaaatgcataaagaaaagattctactgggcacatcatagtaaggctattctcagctcaataactaggatggtgtccatagcattaaataagctgctacctaatatgaaaaatgatgtggcaagtgagtaaatgaggaaagagaagaaaacaaggtcttgcatgagacatggtttctacacaacattgaagacatcatgtgagataaatttaatttaagcatgaaaaagtggtgtttgtattgaaaaagtagtgtctaatactagtttattgatgatgtgaagtttatgaaaactaccgtgtagtgtcttgggttggtactgcctaaaggggccggctagctatataaactgtacagatgcagagaagcttgcacaactagtgcatccctgtcactgtttggctagcttaaccttcctgacatctatcctctggattgaacggcaggagatacctaagctagctagcaatctctatcgatctgtttgtttacatgttcagttaaaggttactgagaaatgcctagagtttttccggctagcttcataagttagtgggttagctgacctagattcaaagtctaatccttttatttatttgatattagatatcctaacgtttttagttagaggttattaatttgacatggccggcagcggcagggacgatcctcttgtggttggcaggattgtgggtgatgtgctggatccattcgtccggatcactaacctcagtgtcagctatggtgcaaggatcgtctccaatggctgcgagctcaagccgtccatggtgacccaacagcccagggtcgtggtcggtggcaatgacatgaggacgttctacacactcgtacggatcatatcttggatgcagagacccaccagaagttatttaattactttcattaattatcataaaactagactataaattatattttttacatggatgcatgttaattttgtgtggcttacgtactaatctaattacctacaggtgatggtagacccggatgctccgagcccaagcaaccctaaccttagggagtatctacactggtaggcaccgatcagatatgttagctagctaattgtatacattcgtcctagaatataaagaatttggaccggattctcaatcattcgcgttgattctctttgtctgtctgtaggctggtcaccgatattcctggtaccactggagcaacatttggtcagtaaactagtatatatatatagtactcatatcaatttcgatgtaacagcaacatatgtggcagttccatgaatttttattaccttggtcctaccccatatatatacttcaaaaattgcataatgacaaaattatactccctccgtattttaatgtatgacgccgttgactttttaaccaacatttgaccattcgtcttatttaaattttttatgcaaatacaaaaatacttatgtcatgcttaaagaacatttgatgataaatcaagtcacaataaaataaatgataattacataatttttttgaataagacaaaaagtcaaacgtttgttaaaaagtcaatgtcgtcatacattaaaatacggagggagtatctattttgtcaaaaattttcgtcagatttgaaggatagggctgtacttcttctatgccaaaatggagggtggtgatcccctcaaaacttgtagaacagccactgttgatatatatatggtgaataacgtagataattaaattgatgcagggcaagaggtgatgtgctacgagagcccaaggccaaccatggggatccaccggctggtgttcgtgctgttccagcagctggggcgtcagacggtgtacgcaccggggtggcgccagaacttcagcaccaggaacttcgccgagctctacaacctcggctcgccggtcgccaccgtctacttcaactgccagcgcgaggccggctccggcggcaggagggtctacccctagctagctacgcatgccacccggcctccatgcatgcagcagctatagctaagctgagacctgcctagctgtatatgcatgcaggctcttaagtgtgtatatataaataaataaatgtatatctactattataaaattataaaaatataaagatgctagcgttcatgcattagctagatcgatcgatgtatcaagttatcatattatctctcctctatgctaatataacaaatgaattattattgcaactgaaacttttactatatatattgatacaattaattattctagttttctcataagctagccaaacatttttttctcttttaccattaatttttaaaaatttatatattgaacatcataatatatatatttttttataatcaacatgagaaaataacttacacatttttaaattgtgagaattttcagaaatcgatggccatagaaatgttaaacttgggacaaagctatcagaatgaaaagtaatttgaaaatgagggagtagaaaaaaccaataaggtataattcacttcagtactatgcatggtacaactagtatgctagtgatcaaaatcagatacacaaccatgagaagactgtcatgtgctggacatggacttcacagtgggccggatgtgggttgtcataggaaagggggcttggcccaggagcaagtcatccagagtataagtacacactccaacaagagaaagggggcgatgaattattttgaaccaatggctgcggcctcctcctcctcctcctcctcctcctcctcctcctccttctctgtgtcttcttcctcctctctagagttctcccacccccaactctgatttctactcctggattcagattctgcttggcgtgacgccagcgttgtctcggattccattctgctacatgtatccaagtaatcgagtgattactgctgtgatttggctctagaattgtggttgttctgctgtgatttgtgttgattcgatggagaatatgttggatcgtgacaatatggtatcagagcagtcgattcatgggattccgatccgggagatgcagtggacgacacatgggggcagtgacgactgttggggccaggatttgagccatggaggtgacactgtcagaggcgcccgccaggtgttcgatgaaatgccaagccggttaggaagtgctgcaggtgctgcact

SEQ ID NO: 760 - DNA, 6346 bp, Oryza sativa
ttaaccattaaaaaatgaagggaaagaataatattaaagtccgcccggttcttcgtataaactattgtgcacagaaattctacattatgaaaattgacatgcatgggctaattttttttattttgcaataaataacggaaaatgttagcgattgggcgctcgatcagcgccagaaaaatcgtgcgcccgccgcttcttgcgcctccgcgcgcacctccgtgccgtccccaccacgttccccaccacatacgccattgcaacaaatcacccacatattacgaaaacgctctattaagaaaatccgtttcattttttgttccaccaacaatgtttcagcaattatactcgtgatgtttcattatgtatagatcaaatgttgcggtgaattgaaacatcctttcgctatttgatgaaacattatttttatatatggtaaaacaacttaaaaaagacaaaaaaaaaacattgattcatacgttgcagcaaaatgtttcatgagtggtgattttgttgtgtttcaacttttaaaacgattgaaacatttttttaatctacgtagttaaacaattccgaactacttcgtgcagcgtccgatttatagacgcctctagataacaactgttttttccaaatgtcccttaaccacatataatataaaacaaataaaaaggacagttagaaatgggcgaacatttcgacatgggcccatccggcccaataaagaactaaaaaagaggacatggacatggaggagctcgcatccccagtccccgtcacgtggacgcccattggccctcccgccccccatctccaccatggcctacacgtcagcgaccgtcccatctatcactccatcccctttgggaaatcccaccacctaccattccccatcctctaccctaactcactgacatagcgggcccacttccatccgggcccacctgtcattgtaatgggtacgcactatgtaggtgagaaaggagagtcccttacccgtcgtcttcctcctcgagacgccattgctgccgaggttgcttgccattcccggccattccaatccactcccaccaccaagcgcgagctcgattatttttttaatcgattttctccgatttaatccgtagaaaattccccactcctcctcctcctccaccgccgccgccgacgccgcactcctcactccgcagaagcaacaccaacgccgcactccaacgccaaccgcctccgcgcgcggcccgtcgccatcgtcgagcaccttcacgcttcctcctcccccgcacggaacggagacccctagcgccgctataagagggagagaggtgggcgggactcatggcgcccgcggcagcgtcgctcacggcccccaacgcactcgcggcgacgtcgttgcccttcttgcacggaaggaagagcggcggcggcggcgtgtccgtgcacgccggggcgccttcgccttcgcgggcggtggcggtggtggcgcggaggttgtgggggagcgctagcagtagcaggaggatggtggtggcggcggcgacggcggcggagatggcgcccgcggcgagcggggaggaagggaagccgttcgtggaggagatgagggcggtggccatgcggctgcacaccaaggaccaggccaaggaaggggagaaggagccgcaggcgccgccggtggccaggtgggagccctccgtggacggctacctccgcttcctcgtcgacagcaagctcgtcttcgagacgctcgagaccatcgtcgaccgcgccgccgtcccctggtgtgagtgatcggaaaagctcttcctcctccgtgctctactttggaccgcttggaatttttgtggatgacgtttttttttagaaaattttgaactgaaatgatatttgattggttcatacggcgacacccatgaaagttggaaatatttctcaccttctgttctagaatagtcaaatagtataattgtttagccagaaaaaaattggatgcacagctttttgtgaaggaaaatgtcaaattgaagttggatgtgccatatggtgggagtaggagcacttgcaaaccccctgttttgagtttggtttggatgcttgagaaaatatatgtaatccaagttaaggtattaaaagactttgagcctatgattatttcatgtcatcgaggaaattgcatcagctttggataagtcagctaccgatctgaaatttaaataaaaaaaatgtatatttccccttctgttacatgatatgctcttccactgaccataagaccagtgccatgtgcaggtggatccaatttaagtaacattcagcccacattttttaaaataaaacaaaggcatttctttgtcattgagaggcatccttgcctggcatgctgctagcaaaacatttggcaggcacagaatatgtttttgggagggtcttgataaaattgtttaggtgtttcgaaagtgttaaaacgctttactggcaacatttctttaagagtatcatcaaaatatcaatgtttgcctatatgtatcaagtaagaagtacaggaagccatgtgcatgtctatttgcagttggttggcacttggcggtataatcatctaaagtagtaccttactattggttcctattctatgggcaaacttgtatcgaccttctcgagagacatcctatattcctattcatggatgccttaaatcactaaaattttcattgtggctccctctgctgtttagaggtggcatccccagcacagttattttctgtatccacactcctgtattgcttcccttaatcatgtataagtcttgtattttggcattgtattgtttcgacacttggaattagaaatccttatattacattaccacttggcatgctatgtgcagaattacctcggtaggtttgtacttgcaaacagcttatgttggcaccatggtaccccaattttacatactcttgttctgttattctgctatggtctggtatgcaaataacacaataaacgttgcctccaattttggggggtgcacatcatgcagttattctgctagttgagttatgggcagcattttctttataacaggatttcttttgaaggaaatccttgagtctttataacagaatctttctggaatccgccttgtccttaacccttgagtctttgttacaccctttcatggacctacgttgtccgtcaatttgcctccactagctctctgtgtattggatggttggatgtgagaagcctctttcttattgatgattactttgcattttgcaaggaaaacatttcactagcaaagaaaattaaataatatataatgttaacaatgataccctttatatcttctagcttgcttgctgaagttttatggtatctggattgtctgcatttatctgtattggtgaaactctagatttttctatttgttttacatttgagttttagaacaacacgtagcttcgtgtttggctagttgaccagttccacttaagtacttctccgtttcatattatagtcgttttgattttgttgtagtcgaactttttaaaatttgaccaaatttgtagaaaaaatatagcaacatattcgacacaaaacaaacatattatccaaatatattaaatgttagttttaatgaaactaatttgatgttgtagatgttgctaaatttttctataaacttcatcaaacttctttaagtttgactaggaaaaaatcaaaacgacttataatatgaaatggagggattagtaaataattgagaagcaaataatgagtacctttattctactcctacataataccgtgtgcaatttgtttgcacctgaaatcttagcaggatagagaacttttgtagttttgtttatgctgtatggaagtatggaacaatgagtcataattacttgaacgtccacataaaatctgtaatattctttttagatggaaaattgaaactactataaaacagctagaagatttcttccatcaatatttgcaagaggctgcttattgacttcctatttatctgtatgtatttcagatgctgagttcaggaatactgggttggagagatcagaacaactgaagaaggatctggaatggttcaaggaacagggtcacacaattccagaaccatctgctcccggcactacatatgcttcctatctggaagagctggctgaaaaggactcccaagcttttatctgccatttctataatgtgtattttgctcatacggctggaggccgaatgattgggaagaaggtacagtttctgtcttttttaatgatgaattttttatatcattcaaaagctcactatcttttggtaacatagttcagaatggattcctataaatgcgtagaatattagctatcgaagcaacaaaactgacactaacagaaagtttgttctttgcttcattgcgctttcctgactgtatagtgtggacacttttgatgtgagatggtttcttttcttaggaatcagattgaccggttgctttggatgcttatattggtattttgttctaacaaaattatagagtacgctagtcgagataatgaaaatactacataaggcagcgagtgctttggcacgcagtcccttttaggatcctcttgccactactgttctcaagttgtgctgctcatagacgtcaaggtttttcaacccacctgacattattacaatgcggttttgtttgggcatatgaatagcagttttccatgcttgccacctcatttggttcaacttgtttgaatttcttaaacgtttaatcatgcccttgttatcatcttaggtctctgagaatattctgaacaagaaggagctggagttctacaaatgggagggcaatctgtcccagctgctgcagaatgtccgcaacaagcttaacgaagtcgcctctgtaagtccaggagctctatttgccacgccactatctcccccaattctttgatacgagcagtttgaaatgttgctaataaccaagctttaattgttccatttgctggccttgcagagctggacccgggaggagaaggaccattgcctggatgaaacggagaagtcgttctcgtattctggagatctcctccgtcacatattcacctaagcttaattgatcacggtgtctgctatctagtcttgataaacgctgtaaatactaaagttcacgtcagtcagacagactgttactggacactgggcagaggtcatttacttactcaaccagttggccttgcctcccatcaaattgccaaattctaataatccttcggtgtgccacttgtctgttgctgtgctagcatctccttgctaattgccaaatgggtaatttaactgaaagttcttgcgttttcaggcgactgaaatgtgacaaaacaaatagcataaatgttgttgatctcctcgacgtattctccaaacaggcttatcagttatcaacatatgtaactcaaatttcgagtgcaaaataatgaagttctccctccacaccctaataaacatacaatttcacctcctcgcaagaaaaaaaaaatcagagaagtcctttttttttttttttgctagttgagagcaacttactagtatagccttggtccaaatttcatccctgaacttttatatcatcaaacatactacgtctttcaactaaaaaaatgtttgcttttttatgtgttgtttacgcgtagcgccaacaaaaagaagatgccacatagaagttgtaagttgtaacaccctccacaccatgcaagctacaaccacttgtctttttttggtttcagcccttatcagccaattacatttttatttaaatactcagattttctttattcatatataagtctaacattttatattacgcactctgaaaataaaaaaacttatataaacacccaccctcccctttcactatacctatacgtcactcctccgtctcccgtcgggcggcatcaccgcctctcccctccttagcgacgcctgcaagaagacgagctcgagctcctctctcccctcctcggtggcagggacacaaatcgaggtggcgtggtgttgatagggacaacggcaatggatctaccctatataacgacctcgacgacggatctgccgaaagcggtggttggggttgtgaaatagctggcactggtgcagattgaggcgccaatgactggcgaagcttcccggtgacgtcttcccgtgacggagtgtcttgccatcgtatatgcccttattcttccctgccattcccctcgccgtctttgctaccattgcagagtccgtcctcgagctcgcccgatctgcacgacgatgacaaccatgacctcgtttatggctataaggg

SEQ ID NO: 761 - DNA, 6414 bp, Oryza sativa
caaaacagacagtttggaaacagcagcatgaggatttggcttctccaaaattaccaggtatatcacacttaaaagggacagagcagcaggtttctttcggtatatacccagttcttttactcttttagagttgtcaaactcacacttttgcaagaatgtcctccttgtcgaccataaaattgcaaagctatacaatgtatttgctatatatttatcattagtatgtcatgattatctttaggaaaagttaaatattgaaacatcaaagcacgacaatactaacatgcttgcctgagttgtagctttgcatgaccaagaaatttaatcacaggggaatatgtaaatccatatttcatatttacaggtaatataatttgatcctcataaatgtagatactaatgatttctatagttcctttaatagaaaatgtatagctataatacatccacatcaaatggaagttatattttcattatctaaaaaaaatatttttttaggcaggtgagattccccacctaatatcggcaccaaatgatatgtgacgacataataaaccttcattttccttgtgatgaaaaagtctatacaccatgacaactaacgtatagatatggacaattgtatagcacgcaagcatgaatggcagtattttttttcgcccgtcattcttgtcgccgagatttaatagcggcgtcttttaaaagagagttacctaaatatttcaacgaaaattaattctctgcataaacattttaataaatctataatatcatgcgcacgtccatgttaatggctcgatcacatatacgaaacacaaatacacatttcatacacaaaaaatcgtaaaacaacgatattatctttctcctgaagcggacatgacgcgacccgcggaactgataaagagaaaagagagcgacattttccacccctcccctttgattgtttatctcctcttttttatgtgttttccccttgtgtttttttctcaatcatgttttccattccattgggtttggtgtcgtgttgtgaatgtgttgagaaagagtagaggagagaaccaaaagggtttccagagcggcagcggctgcctgcttagctgctgctgatgctgcaggctgcaccaaagcagcgagcctttttttacctctcctactataccaccaccaccatctcctctcctcggcttcacttctcgcctctccttgttggcacgggcggcgattgagcccgcggcggcgccatgtcggggctgtacagcccggggttctcgccagcgaggaacctctccccccagattaggagcaacccgacggatgttgataggtaactcggattccatttcccgtgtttcttggcttttgttgtgcctttgtgttcttgggctgatgaagctgatggtgtgttgtgattggttggttggattgttcttgcagtcagtatctggccgagttgctcgccgagcatcagaagctggggccgttcatgcaggtgctgcccatatgcagcaagctgctgagccaaggtgagatcttttcttcttttttttttgatctcccctcttcatcgtttctcgctgtgcgacgagattttttgtttggttttgagagaggtgtttcctttgcaatcgatgaatttgggaaaaacttacatggctccgatgcctgaatgggcgctcgcgtttggatagatggcattggtggtttcttggctctactgcactgtcatctctgacgcatgagctgcttggatggcgttcttgttttagatttgtgttgcgattttacctcaatcggacagattggatgatcaggcttctgctagataatgttgccgcctgatgattgcgatgatcgatctgtccttgataatctacgctggcgatgttgtagaacgatcttcttggctgaaatatcaccaatcattacatctttgtcttagatattcatcttatcattctattagtaagaatcatatgtttaatttagagttgattttaacagtaggatgtaaaaacagtgatgaagctcgtggtttgtactagtgggcagtggtaaagggtttctatggacgtcaagtcgtcaccttattatgcttatctcaatcaccatcaaccaatcaatgtgcattaccatttgccagcatgacgatttcaacatttttagacaggccttgacataatcagttttaacatttttagacaacccttgacataatcagccgtacttgatataagtgattttggtactaataattttagtcatccgcaaaccgaaccgtagaacactctgcttgatatacagcaccttccttgtgctaatgctggaaaaattataacttgcaactgaaaaccaaacgcattttcttgtttaatcaggctataccactgtgtcaggtcacttgtagaccatgacatataggattgttatatatcatcacattatagcttgaggaattttctgtcttcttcattcagaacatcaataattgttctctatagtttgtaagtggtgatattggatcaaatcttgcttcacaatgcgatgctattcgtttagattaccctgtagaaactatactctggccatctgtatactgtaggcctattggataagtacatacgaaaggggttaatattacaggttattgcttctgttattgaatcatgttgggtctagttctattcatatgtgcttttagttacctgtctttctcctgtgaatgtttatccattgtataatgaactatcatttcttctccttttcttgagagaggatgaactagcatttcttatcttggttctgacaaaaaagatttagtagcaatgtccaaaattctgactgtaataaacaacttgtatattcattctgacctttatgctactcagaaattatgcgggtatcaagcattgtccacaaccatggatttggtgattttgacaggcatcggtttagaagtcctagccctatgtcttcgccaaacccaagatctaatcgctctggaaatgggtttagtccttggaatgggctacaccaagaggtaggcattctgcaaaacttatttgccatccaatgcatcaatgtattctgagcttagcagtttatagtacactaaagccaataatatggtaattctatggaaaattcactcccacttttttctaagacagattggctgctactcatcatgcagtgcacatgttcaagatgatttgtcaaaaatactgataaagcattatccttgccctttttgaactatgtaaaagagattaggttttcctcaaggaaccagcatggattggcagggagcaccaccaagccctagttctcatgttgtaaaaaagattctgcgtttggatgtcccagttgattcttatccaaatgtatgatacctccacttcatgtgttatattaatgttaacaaagaataattcttgagatcttttaattacttattttccttttccttttttcccagttcaattttgtgggacgcattctaggtcctagaggtaactctctaaagcgggtggaagcatccactggctgtcgtgttttcattagagggaagggttccatcaaagatccagggaaggtaatagtttctgaagtttgatttgcatgcacttctattgcttcttgaatcatcaggatattattatgctaacaagtagttacaacaaactatgttttttcttaagataacagtagcatcttacagtacattattaaaatattgcttaggtatgcaaaatttgggttaaactcctgttggtagcacttttaatttcagtaagtatattggaactgtcttcctctgcaagggatttcatctcccaccaagcttgctattttattacctcttcacagtccaaatactgtaatccctgtagcatacaactatagcttacatggttggggttttttccccaatcatttcgacagcatactgtacttgtaagcttctattgtaatgatcttttttcctaatcttaataagattggtcgaccgaactttcggccgagccggcgaaaaaaaaaatgtttcatcctgcttagctcataccaaagttttaattgctctgcttttgcctcctcatatgtgcttcgtcctctttcttcatagattctactgacctgcctagcgatcaagctcatatattcccttccatgtttctttgaaggaggacaaactccgtggaaagccaggctacgaacatctgagtgacccactgcacattttgatagaagctgagttcccagccagtatcattgatgcaagattgagacatgcacaggaggttatagaagaactgctaaaaccagtggtgagtaatttgcatacaccctatttgtgcaggcctagagtatttttgctagtctcctagggtaactgagtgcaaaaatgattgattcccggagaacccaaagaaaatgtgatccccttggtattggtttgaattgttaataactattctgaatgttttcctccccttcatactggtcctgaaatgtcttcacccaaaagatagctcatttcttttatcatgattatttactaccagtctctaattgcttctctctgttttattttggaaacccattcctttttcacatgttctgttctgaaccttgtgttacataattgcttctttctccagcaatcctttaatttgtaatgaagttttcgtatgcctgactaaacgaaatcgcatcggcttcttctgcaggatgaatcacaggatttctacaaaaggcaacagctcagggagctggcaatgctaaactcaaccctgagggaggacagcccccatcctgggagtgtctctccattcagtaatggcggtatgaaacgcgcgaaaacgggccagtagagaagcaactctaccaccacccatttgaggtggtatccaggtgccttatgcccttaaaaaggatggcattggcacaccttcaggcattgtttgccatgggtgtgtgtgaaggaagcaatgcaatgcaccttcactagatggagtttggtatcagtcagattttcgccttcaggcaggggaaaacttcagggacaatgacaatagtcgcagatcgtccggtcgatccacctttggtttgttgtaaggtctcaagaacatttgttttatttgttattgactgttaaccctagtatgtggtgctatggtaggttatctccatgacaagctagagaaggcctgggatgtgagcctttttttttcttccatttaccccccatttaggtgtttaattcaccttgtattatatcctttcacatttatggagctgtgaaaaataaaagaaggatgaagggtcatcctctttcttctgccttatagtatgtcagtatttggtttagctgtaaaaatattcgaggttattcctccctccaatttaaattattctagctttgtcctaaatcaaataaactttgatcaccaattttcaaaaattcgtacagttcaacctactaagatatttgtttctagattcgccataaaaaaatactttcatattatatatttcatcacatgttaaactatacgaatttctagaaatgatggtgcttaaggttttgaagcaggaggagtaaatgccatgaacttatggaatccaatatggtctgtcaaacccacacaggcacacacacagtgttgatgggccatggtggtttgatttccaagcttgattgagttcatggaggcatggctggccctgggtctcctccaaacgcgcggcatcctaagatgagatgatgtccgcttgctggggcacaggaaagcggtgagaccaccaggttttcctgacgagaccacaagttttgcaacgtcatggtggtgttgcagagcagaggacacgaaaagaaatgatctcaattctcaaggggcagctctgtcaaagtctgatggatttaggtgatggcaatagttgtccctgtcaggcttggccatccatgatgccaacagaatatgcttgcattaacggtagtatatgactagctcagcaaattgagaaaattttctatatctaccatagtggaagcagtatccagcagtatgtgcagaatacagatcccagttagtgacagattgctgctcaatccaacaatgagcaaaatcaaatcagttgcatatgcaggaaaccagcacaatatacttttttttataatataaaagtatacaccataaaccaatacatcaaaattaccagcgacgtactgaaaaaccatggtgcagacctgaagaccgaacatgccaaaccatgaactcaaattattggactacagattatcaggcacaccaacacaaaagacattccacccaccacatatgtcaagaaaaggtgggaatatatttccagacaaaatatactaagcttaacaagattacgaaaaaataaatt

SEQ ID NO: 762 - DNA, 6107 bp, Oryza sativa
cactatttaccattctgccactagccgaggtctcctcctcctcttcttcttcccgctgcttcgcctcgcgctcgccatggccggcgaccgagcggaggaggaggagggggaggcgccgcctccggaggcgcgtgccgcggcggcggtggagagggtggcggcggattcggctgctggggcccttcgtggaggagctccgggagcggaggcggggggagggggagggggaggaggaggagcgggcgctggcgccgctcgccgacgcgctcgaggcggcgctcgcgctgctccggctcggccgcgaggggagcaggatctccttggtatgtgcgcgcgtgtgggtttcttgattttgttcgattcgtggtcctggctgcctttttgggaggaactattattattattatggattggtgatttgatattatgacctgttcttaggtaaaaataaagtgcagctttagttattaagtttattattgactttagtctcctaaaaaaaattaagattcttggatgcaaaaatatgattctgattcgtctactgtgtatccgtgcttaatttttgcttttataaatcgtgtggactaatattaatatatattgatgtgcagttgtttgaaacacaaaacaaattgtaggggtcgtgattgttaagtgagttttcttttgttttagcataggggctttaggatgatttagttgctgttgcttattaatcgcaaaaaagagagagagaaaggtttccataattttattctgcagctgtgttgtatttgttcagctagatttcttgttgagctgagattgcttcttgttcaatgcgaccaatatatgttcttcttttgtggtgcaattttggtagggtccataagttgtggtctttgggggcgtctgtaacttggttatttcagatcaaactccttgctatttttttttgtggatctactgcgaaacttgtcatctgtaaatgatccatgcattctcatttctcagggcatccatgagtttgtcatagatttgctgtagaataaatgcttggacggattcctccatcggtttctttacttgttgaaacattcaagaatctacttgcccttgccctacatccttcatggttgtactccacatgttattccccatggtaaaagcacggtttgttgtgtggattagttgggagaggcaacggatagacatatgatcatgtctttctccatggtaaaagcaagatttgttgtggattagttgggacaaccatatgatcatgtctttcactttcttgtgtgttgtttgtagtggatattgtctatagctttgaattgttcttttgaggagaggtatgatcttccagtcctgagcaattcaactgctccttttggatcataaatttcacctcttgaatcattatctagccagtttttctgcctaccagtatggtacatcaaatctgaccgattggagtactatgttcttttgtcaagtataactgtattattatctgtatggtatatctaatcataacagacattttcatttttctattttcactgggacaaagaacttgtactaattgtttgctttactttggtcaaatctggttgactgtatctgttgtaactatcaaggcctcaaacccttcatcgagtccgtgttatcaatgggatgctttatgagtgctatgacataatattggtaatcaatagtctttgaacattattttatatcttgatcgctcatacaacaatgatgactatcttgatcgctcatgcactatttttccggattaagaactaacttctggctgggtagttgttgaaattgttcaggagttgaataggccacgtgctttgtcagaaaattaaatagcagcaagtaaaaggttttctggaagctttcatgttaaattctttttataaactagcaaatgaaatggtctgaagaagcatattttcattttggaagtgcaatattgcttagtagagagtaatcaaattgggttctatacctaccacttaatgctcgctgagtacattgacccaaaaatattatttctgagcacaataggtttcattaaacttttatactgaaatacaataagttgccgcaaccagagcagatcaacaaaatttgtcattagagaacttcagatgatcgacatcataactatattgtttgtaggctcaaacattaaggtccccaccagtggatttctgcacccgttgaaagtgtttttcttttttggcctgttggaatgcccatgtacctgatgataggactacctctatgactcaccgactatatcttttacggctgtgcatagggaagggatgaacctacaagttagaaatatggtagtcattgtctagttttctttatgtgactatcaaactcatgtattgattcaacgttttccttcttcaactccattttgatgttattgaaagtgcttgctcattttattcccaagctcagaagcaagggattttcttgattatattggtgtagtttaaatttcaggttggttttcttgctctttgcttcagtacttgaaccacaggcctctgactgtccatcctgtagcttgtaatgtttttatatggtgctcttaatgttggtgttactctatctcttttttcccctgctttacctgtattcttattgacctttgattaccattttgttcttattataaatcattttttataaacatgcttttcgaaacactaattgctgtggatttgtttctgtacaaccacttgtttagctaaggagccttttctttctttcttttcccattctggtttgcaggttcttgagagggacagcgtaatgaaaaagtttcagggagtaattttgcagctggaacaagctctgtgcgacattccgtacaatgaattggatatatcagatgaagttagagagcaggtaacgatgacagcacactgaaaagaattcctcttgctattatcattaagcacttaaatccagcattggagataattatccaaatcctgtccaggttgagttagtgcacgcacagctcaaaagagcaaaagaacggattgatatgcctgacgatgaattctacaatgatctactatctgtatatgacaagaactatgacccaagtgcagaactggctattcttggaagattgtcagaaaagctacacttgatgacaatcaccgatctcacgcaagaatcactcgccttacatgagatggtcgcatccggcggtggtcaggacccaggagaacacattgagagaatgtcaatgctactgaagaagattaaggattttgtgcaaacacagaaccctgacatggggcctcctatggcttccagggtattggattcaaatggggattcaaggcctataaccattcctgacgagttccgatgtccaatttctcttgagctgatgaaggatcctgttatagtgtctacagggcaggtagcaatctctacctctttatttttaagacccaaagcacaatgcaactaaaatagttattttagtataaacattttttatttgttaatttgtagacatatgagcgggcatgcattgagaaatggatagcatcaggccatcatacctgcccaaccacgcaacagaagatgtcaacctcagcattgacgccaaactatgtccttagaagtctcatttcccagtggtgtgaaaccaatgggatggagccaccaaagcgctcaacccagcctaacaagcctacgcctgcatgctcttcgagtgaacgtgctaacatcgatgctctgctatctaagttatgctctccagacactgaggagcagagatcagctgctgcagagcttcgcctccttgcaaagcggaatgcaaacaaccggatttgcattgctgaggcaggtgccattcccttgctattgagtctgctgtcctcatctgacctacggactcaagaacatgcagttactgcccttctgaacctctccatacatgaggacaataaggcaagcatcatatcatctggtgctgtcccaagcatagtccatgttctgaagaatggcagcatggaggcacgggagaatgctgcggccacactttttagtctctcagtgattgatgaatataaagtgacaattggagggatgggggctatccctgcgcttgtagtgctgttaggcgagggtagccagcgggggaagaaggatgcagcagcagctctcttcaacttgtgtatataccaagggaacaagggacgagcgattcgagctggccttgtgccactcatcatggggctggtgaccaaccccacaggagcgctcatggatgaggctatggcaatactctccatactatccagccaccctgagggcaaggcagcgattggggcggcagagcctgtccctgtgcttgtggagatgatcggaagcggaaccccgagaaatcgagagaatgctgcggctgtcatgctacatctgtgcagtggagagcaccatcttgtgcatttagctcgtgcgcaggagtgcgggatcatggtcccgttgcgggagctggctttgaacggcaccgatagggggaagaggaaggctgtgcagctgctcgagcggatgagcagattcctagtccagcaacaagaggaacaggagtcccagtcgcaagcctccgcgcaggtccctcctcaggccacccctgagcaggtcccggaaaatgacatccctgaacaattggacagcccagcgtctcaataccctatggttgtatgaactcgatgatgagcgagtcatcgtcgcaatcctatcaaatgtcggattgagtagcatcctggtcactttgcattctgctcatgattcatggcatgccgaccaattgaggtttttccacaagcttgaactataaggtttccatgcttgtgtgctgaaactcccaggttgtgagaatttgtttaggcagcccaggatgttgagatagatgtgtacagtttcttaaacatgcagctgctatatgtagacaacataatgcaaggttttcccatgtatatcctgaagactgtaataccatatgtaaaagagaagtttcaaatgcggatttgagcagtaaatctgatggctttactactagtaactactccctctgtccaaaaagactcaattcctgagtttttttgtctaacgtttgattgttcgtcttatatgaatttttttttataattagtactttcgttgttgttagatgataaaacatgattaatacctcatgtgtgacttatctttttaaattttttcataattttttcaaacaagacggacggtcaaacgttggacacggaaacctagaaattgagttttttttttgggacggagggagtagcttagaatttttgctcatggttgttccatatatagcgttcatcaggtcccaatacatgtctcaagttacataatcagtactccctccggtttgagactaattggcgttatgggttactccctcaggtttgagtttaattaacgtttttgctttctccactactctctcttttctatttctccagaatacccctcatgcatgcatgcaaacagaaaaaatgcttggagtattaatgaggggtataacaggaaatatggatctaattaatacttcattggtatttgccatgatgtccaaaacgtcacttaatctcaaaccggagggagtatgcatcaggtgattgcaacagtgccaataattgcatcaggtgattgcaacagtcccaataattgtactccacctctcaagacaagttaattacgcacctccatttcacacagttgaatggcaattctgactgcaatgtaagcagatgctatttcagattctcagttgaacattcaattactcaattgtattataaattggcaaaattttactactactcatcttaaaatataacaatttttagctttgaatctggataaatagctattcaaatttatagctaaaaatgtttatatttgggatagaggggtacaggatatctaaaccttgtgatcttcactgtatggcgtcctaaaaatgtgactacttttggtcagcctgaaattgttaattaccagtaggacactacaaccattttttttttccaaac

SEQ ID NO: 763 - DNA, 14552 bp, Oryza sativa; identical to SEQ ID NO: 524

SEQ ID NO: 764 - DNA, 6405 bp, Oryza sativa
ttacctggagaagtccattccaattggacgagtaatctccttgggcttttatttctccattttgcctttggcattttgagtgttcacttcgaatttacgttccataagtattacttttcatttagtattctttttcttcttacgtataatttccttacaatgtattggtgtgttgtaagtatcaactctaccaaagtatgaaaacatgacattaattaatttttgacatagacgttaacggttttttaatctcattcaattcatttatgttttaattttatgtctttcagttagctctattcttaatactagttagctctattcttgatactttatgcttttacaagaggagcataataccatacgcagtggagctgcattcttggagtcggtagccaggggtctattttttcactttggctaacatagttcctataaaatattgttatagattctacgcgttttctttttacttcatccgtttcataatgtaagactttctagtagtgaacgtattcatataggtgttaagtatatatgactagatttattaacactcatatgaatatgggcactgctagaaagtcttataatatgaaacggagggagttgtatttttgctgcatatgatcaataaaaaaataggggtttttccatatccttgagtttttttatttataatgagatataaatcatttccattatatataaaaaatacacccacgatctaaggctgccgcttaaatatcttaaaaaaacgtggttttatttgtagagtgcaggaaatgcaatttgacaactataagccggcaagaaaatattaacattggatcggcagtttgggagtagcaaacaacgcttaattatataagtactgtactactactaatcatcaacgccttcttcgtcctaaaaaagtattaggacataaacgcggggtgttctccgcaaaatgtgattattttaatcggtgttgcgccagaggccgcgtcttgagcttgctctctctctctatcactctgctcagctcaagtagccagctcgaacaagaagaagaggagaaaaaaatcgcgcagcttctctccctctctcttacttatagcagcagcagatccgcctcccgaaacccagctctttgtgatcctcaagagccgcctccaacccccaatccacgcgcgacccaagaatccgagaaatttttctgtccagaataagagggtttggtttgattttgggagctccagttgttttcttctcctccttcttcttcttcttctttcttgcaatttgaggaggtttgctctggtttggtttggttctttgttgttgctgccgctgccgcggcgaatggtggcgacgcgaggaagggaatgggttcgttctcctgcgccgcgggcgatctgtcgtgtcgagatagtggcgcgccctgacctgagagatgtttgttcttgttgatttttgtgtgtttgtttgactgaaaggtgctcgtccttttcggaaagtgagggggtttgttcttatttctggttcttgattattattaggattagtttgttcctttgtgtgattcgattccttgccgcgccaaatcttggtttgagatttttctcttttccttttctctctcttggattggatcctttgcctccctcgccgcccattcctccgtgcgatttgagtacttcttggagtgagttcttggtgagtgagatcgagtactttgaggaggatctagaggagatggtttcgagatcctactccaacttgctggagctcgccgccggcggaggaggaggaggcggcggcgaagggccgctgccgtcgctggggcggcgacggattccgcgggtggtgacggcgtcgggcattgtcccggacctggactactccgacgacgacgcggcgtcggcggcgtcgtcgtccgaccactcctccgcccactcccacgcgccgcgcgagcgcgccatcatcgtcgccaaccagctgcccatccgcgcgtctcgccgcggcggcggcggcggcgggtgggagttctcctgggacgaggacagcctcctcctgcagctcagggacagcctccgcgcccacgccgaccgcgccgacgacatggagttcgtctacgtcggcggcctccgcgacgacgtgcccgcggcggagcacgacgaggtggcgcaccacctcctcgagggcttccgctgcgtgcccaccttcctccccgccgacctccggtcgcggttctaccacggattctgcaagcagcagctgtggccactgttccattacatgctcccgctgtcgccggagctcggcggccgcttcgaccgcgcgctgtggcaggcgtacgtgtccgtcaacaagatcttcgccgacaagatactggaggtgatcagccccgacgaggactacgtctgggtgcacgactaccatctcatgatcttgccgacgttcctgcggaagcggttcaaccgcgtcaagctcggcttcttcctccacagcccgttcccgtcgtcggagatctacaagaccctgcccgtccgcgaggagctgctccggtcgctcctgaacgccgatttgatcgggttccacaccttcgattatgccaggcatttcctgtcctgctgtggaaggatgctcgggttgaagtatgagtcgcagaggggctacattgcgctggagtattatggtcggacggttaccatcaagatattgccggtgggagttcatttggagcagctgcggtcggtgctcaatcttccggagacgggggtcaaggtggccgagcttctcaagcaattctgcgatcagaaccggctgatgttgcttggcgtagatgatatggacatctttaaaggaattagcttgaagcttttggcatttgagcagctcctgatgcaacatcccgaatggcgaggaagggtggttctagtacagattgccaatccagcgaggggacgggggaaagatgtgaaagaggtgcaggatgagagctatgcaatggtgaggcgtatcaatgaggcatttgggcagccaggttaccagccggttatattgatcgatcggccacttcagttctatgagagaatggcttactatgttgtcgctgagtgctgcctggtgaccgcagtgagagatggcatgaatcttatcccgtatgagtatgtaattgctaggcagggcaatgaaaaactagacgggatcttaggtcttggcccatcggcacggaagaagagcatgcttgttgtgtcagagttcatcggctgttcaccttccctaagtggtgcgattcgggtaaacccttggaacatcgatgctgtggctgatgcaatggactctgctttagagatgcctgaaggggagaaggtgctgagacatgagaagcaccacaaatatgtgagcacacatgatgttggatactgggcaaacagcttcttgcaagatctggagaggacttgtctggaccatagcaggaggcgttgttgggggataggattcgggctaaggtttagggttgtagcccttgatccaaacttcaagaagcttgcagttgagcaccttgtctcagcctaccggaggacgaccacgcgaatcattcttttggactatgacgggacgctgatgcctcaaacatcatttggtaagagcccaagctctaaaacgatagatatgctgaacagcctgtcccgtgatcagaacaacatggtcttccttgtgagcacaaagaagcggtcgactctagaagaatggttctcatcatgcgacaacctaggcttagctgctgagcatggatactttctcaggtaattattttctctattttacgtaaattcataatcaatgagccaatgacatcaactttattattggactaaaatcagtatgattttgtacttctcattgaattccaactgaacactaatttacacttgtaactgctgtaggctgaagagagatgcagaatgggagacgtgtgtcccagtgacagacagaagctggaagcaaatcgcagagcctgtgatgaaaacatacaccgagacaacagatgggtcaacaattgaggacaaggagaccgcgatagtgtggagctacgaggatgctgatcctgattttggatcttgccaagccaaggagctccatgaccatctggagagtgtccttgcaaatgagccagttacagtaaaagctggcctgaaccatgtcgaggtgaagccacaggtaagctggctcacagcaaagctgtgctgttacctcactagtgttaacatgacccatttctggtacctaagttttaaaccttgaactgttctacagggtgtaagcaagggccttgtggcaaaacggcttttgtcgataatacgggagaacagcctccttccggactttgtcctctgcatcggtgatgaccgctccgatgaagacatgttcgaggtgatcaccactgcagcacaggacaactgcctaagcccagacgccgaggtcttcgcctgcaccgttggtcgcaagcccagcaaggccaagtactacctggatgacctggccgacattgtgaggctgatccagggcctcgccaatgtctctgacgagatgcacagcacaatgcccacacctgtcgacgccgcagacaccgccctgaggtgaaaacacacctgccccagctccacccccaataaggcatgccatcttggaagaagggatcatcgatcgctgctccccccaggtgtacatactcgaagggatgcaacaaaaatgcaatcaaaacacatcatccaccatcttcatccctgcgtgttttcgcatcaaaataccaaacctttcaccggtgtgtacagaaactcggccgagaaattaaccccccccccccccatgttcttctatcaaaaactcagatccatctcaccatcacagtcagatcaggctccaaagtttggccgggatgaatccgcaaccactggagccggagccactccttttgctggcatggtgcaggtgtcaaatggttggtgcgtactaccctttggtggaggcgctaattatttcatcttctttctttcttttctttcgggctcgtgctgtactgtgcccatgtactgctgctgcacattgctgtggggctttggattggattaggtctcttccgttccagcttgtgtggtagcagcagtagttcttgctgccaatgatggatggcaatagtggaggcttgtgtttttcttggtgttatgccgtttgggggttaaaaaacaaagaggctatgatcatgctggtgatgagataaggctataatgctgtctatgttgaattgtagtaaccggctgtaaagagattaatgtgttcctggctgaattgagcaaaaaaaacatttcttcgtctgctccggctgggctaatcatcttctgatctctccgttctgtttgtgtttagttggccaacgtgatatgatgatggattttgatttttgacactaatgctggtcattcctcattttgtagtagcatttagttttctgaaccttggcgatgatactcccttaattcaacaatatatcaatctaatattggataggatacagcgtaattctacgaatctaatatagataatcctttatctagattcataagattggaatgtgttccatccatatcccttttttttcttggaggaggatgcagttttacttcctatttcatggcttctcaacaaccattagttgcgtcattttctagcttaattagggctccgtttgatatttcagttttaaacgcatgtgtaaggcatgcagcgtcgactacactagtggctaccccaagctttgtgtagggtaagataaggactggcttgtgaaaggattaggttaggtctacctgatcctatttttgtttctctccttttcttatctttttgaaatggataggtcgaacctgatataatgatcttgttcatttgctggggtaagggattgttcggtgaaaggattttttttttcatccttctttgaggaatagggtagctgtccatctgtcatttgtcgaagagatataatgtcatcaatttgtatactctcctgttgaagcttcagccaaatggaagcaaaggcagtttggcccttgccatccatgaggagtcttctggtgacagtaattcgcaaaaggctcaccagtaatttggcaaatggctatgcaaagggcttgctcagatacacaaaagttgatggcaaactgttgaactttagagtatattatctttattttttcatgctggcattgtccaatccttgacaacctattatcccctcataaacccataagtttggtaaaaaccataggacttgtgtctgtatttcatttatttgtttagcagcacaggcagatttcacttcaataggagaaagtatatataatccacagattt

SEQ ID NO: 765 - DNA, 4659 bp, Oryza sativa
gatcgcctggcgatcgatcgcccattagcccccccccccccccctacgctcagatggtggccgtcgcgcctactgacctacgtatggaaatgaagcggagacttgttcggcgacattgactggaacgtggtcttatgtgtgcgcacaatcatattcaggtctcgctgatatgttccccccccccccccacgctcagatggtggccgtcgcgcctactgacctatgtatggaaatgaagcagagacttgttcggcgacattgactggaacgtggtcttatgtgtgtgcacaatcatattcaggtctcgctgatatgttcaaactagtaaataccttttgaatatcttcgccggcccggccccggtgaacgaaatgcattctgaatagggcatgcaccgagcaacgaatactgaattgcaaattgtttcagctagctttacaaaatttgaccggttgttctatcaaaaaaaaaatttgaccggttatttcctgagaagttagactcatcaaacattattttttggggcactaaaggcagaagccatgtctcgttcgtttgataaaagaaatgatacacattgaccaaaaaaaccggatcacttccatccataaaaaaaaggagtggtagtcagtcatagcaattctctccaggacgaggagtaccaaaagcagcagcactgtgacgactgacgaagtgacgagcacgagccaggaacgggagaccgggcagccgcagacgcagcaagtccgtcgcgcccccccccccccccccaccccaccaacaccccgtgccgcgcaggcgcgcaccaaccaccacacagccacagcgccgcacacgaaacttccacaccgcagagcccaaaaacctcccgttttctctcctactccgcgacgcggtgaccgtgtgctctcgccttggatcaccagaccatcaccaacccccctccgtcatccgtcctgcaggccacccacccgcctatttaagccgcgcctccccctccattcccctccaagaagagccgcaccatccagtgcagtagtacactagctcttcttcacaacagctaatcgagtagctagaaccattatatactcttctctcgacgctttctgtgctaggttaaccgatccatcttctggtactgaaatggagtgcgagaacggccgcgtttctgccaatggcatgagtggtctctgcgtcgcggcgccccgcgccgacccgctgaactgggggaaggccacggaggagatgacggggagccacctcgacgaggtgaagaggatggtggcggagtaccgccagcctctggtcaagatcgagggcgctagcctgaggatcgcgcaggtcgccgcggtggccgcggccggcgaggccagggtggagctcgacgagtcggcccgcgagcgcgtcaaggccagcagcgactgggtgatgaacagcatgatgaacggcacggacagctacggtgtcaccaccggtttcggcgccacgtcccacaggaggaccaaggagggtggtgctctgcaaagagagctcatcaggtgaggattaggattccaaataagcagtaacgtttacctggtcactgcgattagttcagtttactgtgcaaattctttggacgccttcttaattataaatttgcttgttttctcggcagattcctcaatgccggcgcgttcggcactggcaccgacggtcatgttttgccggcggaggcaacccgcgcggcaatgctcgtccgcatcaacacactcctccagggatactccggcatccggttcgagatcctcgaggcgatcgccaagctgctcaacgcgaacgtcacaccgtgcctgccgctccggggcacgatcaccgcctccggtgacctcgtcccgctgtcctacattgccggccttgtcactgggcgcgagaacgccgtggcggttgcaccagatggcagcaaggtgaacgccgctgaggcgttcaagattgctggcatccagggcggcttcttcgagctgcagcccaaggaaggccttgccatggtcaatggcactgccgtgggctctggccttgcatcgaccgtgctctttgaggctaacattcttgccatcctcgccgaggtcctctcggccgtgttctgcgaggtgatgaacggcaagccggagtacaccgaccacctgactcacaagctcaagcaccatccaggacagatcgaggccgccgccatcatggagcacatcttggagggaagctcctacatgaagcatgccaagaagcttggtgagctcgacccactgatgaagccgaagcaagaccggtacgcgctccggacatccccacagtggctcggccctcaaattgaggttatccgcgccgccaccaagtccatcgagcgtgagatcaactccgtgaacgacaacccgctcatcgacgtctcccgcggcaaggcgctgcacggtggcaacttccagggcacgcccatcggcgtgtccatggacaacacccgcctcgccatcgctgccatcggcaagctcatgttcgcgcagttctcggagctcgtgaacgacttctacaacaacggcctgccatccaacctgtctggcggtcgcaacccgagcttggactacgggttcaagggcgccgagatcgccatggcctcctactgctccgagctgcagttcttgggcaacccagtgaccaaccacgtccagagcgccgagcagcacaaccaggacgtcaactctcttggactcatctcctccaggaagaccgacgaggcaatcgacatcctgaagctcatgtcctccacgttcttgatcgccctctgccaggccgtcgacctgcggcacatcgaggagaacgtcaagagcgccgtcaagagctgcgtcatgacggtggccaagaagacactcagcaccaactccaccggcgatctccacgtcgcacgcttctgcgagaaggacctgctcaaggagatcgaccgcgaggcggtgttcgcgtacgcggacgacccgtgcagccacaactacccgctgatgaagaagctgcgcaacgtgctcgtggagcgcgccctcgccaacggcgcggccgagttcaacgccgacacctcggtgttcgccaaggtcgcgcagttcgaggaggagctgcgcgcgactctgccaggtgcgatcgaggccgcacgtgcggctgtggagaacggcacggcggcgattcccagcagaatcaccgagtgcaggtcgtatccgctctaccggttcgtgcgcgaggagctcggaacaaagtacctgaccggcgagaagacacgatcgcctggcgaggagctgaacaaggttcttgtggctatcaacgaaggcaagcacatcgacccgttgctcgagtgcctcaaggagtggaacggcgagcccctgccaatctgctgaactagtgaaccgattagctgaataacagtggagtgtggaggcgtgcggtgttgtttttatctggtgaatattttatttttacacttatctttgtgttactcaaaagaattcttcgttgcatagcggcaagcatgcaacagcaaaacttggtacgagtggcaggtttcaaaagcaactagtgttgtaacatataagttttggatatcagagtgttgcaaatcattaattttcatggcagagttcttattttccttttagttgtttgtttactccgagtttgacctatctgcgcacaatgtaatccatactgattgggtaaaatgtgcataaatatggcttcaaaaagaaattttcttttattgaaaagaaaataattgtagtgactaaataataacagttcagagatttgacttgtaaaactattctaaactctcaaacgacacccctttacatgtcatttaaatagttatgagaaaaattaacatgatatattaatacgtgataaatcactgcacaggcatgcaatgtcaaatttaacttctacatgttacaacgaaaaaaaaacaaatttaactatggatatatgttaattagtcatagttttttttaacttgtagacgttgaattttaacttttatgtttgcacagtgatctatcacatattaatctttcatattgaacttattaatttgttttcacaaccatttggatgacatacaaataacaatgagatgtcccctcgatagtttagaatccatccccattcgacttgtttcttttatatacctttagtggggattttcatcccacaagggaacatccactcattttttttatgtcacttaaatggtcatcaagaaatttgaaagaaaataacaatatagtttaatatgaaatattactccataaatatgcacggttaaattcaacttttacaagttaaaaaaaattaaactgacatgttaacgtatattcacacttatttttgttataatttgtagaagttgattttcaatttatatgtatgtggagtgatatattttgtatcaatttttttttatttttttatgactatttaggtgacatgcaaaaaatgataggatatcccatctagggataaaaacacgctttgacggttgtgatctgtctgacatgccaatatgactttatgctgatgagtctatattgcagtcaatgtggcgtactaaaatgtacttcctacgtttcacgatgtaagactttctagcattgc

SEQ ID NO: 766 - DNA, 5905 bp, Oryza sativa
aatacctgctagagtgctggttataatctcttttaacatgatttggagctctgttcttttgtgatccttgcacaagggggagattctggttgccattttgacagtccagccgtgtgctggctcacacagtcagcaaatgtggaaaacaatatccaagcaaatgagtctaaaatgtctgttgaagtgttgaggtatatcttctagatatatatcgatctatcaatccttgttttgttttttttattaagagagacatatctatctatctctaaggtgtagtgaccttgcactgacgtgaataatcgcagagcgtgctgctgagtgcgaagagcaaatgattttctcttcttctttttttttgttcggcagagatgcacacgcaataattgtccagccaacaactccggtttccactcgagagcagcctggttttccttttcagggttggtgagatttgtccctccttcactttcctactggctactgcgtgatcaccaacaacagaaaagttttagaacaaagggaaaaccattggaaaacaaacattcttaaaagtgagcaaaagcatcggcaaatgcacaccacaaattcttttttctaaaaaagaggcactttcattcaaaaagtcccaaatttttcatcaggttggttagattactcgtgaacacgacggcggtttcaattttgaaagtcataatcatcgttccgtgtttggaccacgggcaatattatcgcaagaaatagttcgacccatatagaaactaagagaaattatgtgtttcaaatatggcccttcattaattttggccaaatatgataatgtagtgatgttcaagtgcacatgaaaaaaccattctccatggaacaaaaaagtaaagtaggatggaagttatatatcttttttttttatagatccaccatacaagccaccaaccaacccactaggcagagggagaagagaggaaaaggccttacctacctacacccgcccaccccgtccaccgcgccactatttaagcgccccctccgcctccatttccctccaagaagagctcactaccttctcctccggctcttcttcagtatcgaatcctctcttctcctcgtgcccaccaccaccaccgtagcaatggcgggcaacgggccgatcaacaaggaggacccgctcaactggggcgcggcggcggccgagatggccggcagccacctcgacgaggtgaagcgcatggtggcgcagttccgcgagccgctggtcaagatccagggcgccaccctccgcgtcggccaggtggccgccgtcgcccaggccaaggacgccgccggcgtcgccgtcgagctcgacgaggaggcccgcccccgcgtcaaggccagcagcgagtggatcctcaactgcatcgcccacggcggcgacatctacggcgtcaccaccggcttcggcggcacctcccaccgccgcaccaaggacggccccgccctccaagtcgagctcctcaggtaaaaaacaatcatccaattaattacttcattactgccttaattgctatggatagcatagatccactttcaaccacttcgtccccccgcgtttaccgggagtttttatgaatttcttattgtagaagtacaacttcgcccatagatagacacacagctcatgatcccagctcacctcatgagtcatgactgatgagtagcagtagcatcaaagatataaaatgcaagttaaaaaaggcaaaaagcgatgtgccctttttcttggccatcccctgagattcatgggctgttcctactctttattagcaaaagaaaaaaacagaagcaaataaatgcactcccttaccagcatggaattttttgctcatagcataaagtcaagtacagcatccaagctgtttaattctagtaccaagctggaaaacttgtctcatgtgtagtatatacaccaccagcacagctccagttgaaaaaaaaaaagaaaaaaacggccagatctatctcaccggcgcgcgcgacacagcgagttcgcgcgagcgaggcgtctggtggggcgtcgttttccccgcaccgcgcggtggtctcgtcgtactaccgagagtatgcgcacgccaccggcgtgcgcggcggaaaaacaggtcacgctcctcctgtgcccgcccggtgacacgctctcaggaaaccactttattttgttggtacatactttactcctatatgctttgaaaagaaatatacatatgttctttagaaaaatgaataaaagtagtataaaattttgttggcggaaaaaaaatccagtggtaggatataggagtagtatatgtgccataggatgggtgacaaactgacaagtcggcacgtacgagtatcatggtggagaagtcagaagatatatactatatctgtatttaatagttttatggataaatgcgcgtatagattttttctttctttctctgctgaaaatggaatttcgatggaaaatgtatactgggatatttttgtaggactggttcttgtgcagatctagtcgtgtcacgccccacgcgtgccagttagccgggagcacaagtgactcaaggaaaaaacatgttgagtagtcgtacaattgtcagggccatagggtgttcttgtttccaaatcccgatgcgagttgtaacagaggacaagagtttacaaccagttgttccaatttgtcgtctggtttacttgtttgggctgcaacttggcagttaatttaacggttttctgtacagtagtagccatccatgcatccactgcatctagctgtcgatctgtcgtctctgaccatgtgcgtgcttctgctgctgcaggcatctcaacgccggaatcttcggcactggctccgatggccacacgctgccgtcggagacggtgcgggcggccatgctcgtgcgcatcaacaccctcctccagggctactccggcatccggttcgagatcctcgaggccatcaccaagctgctcaacaccggcgtcacgccgtgcctgccgctccgtggcaccatcaccgcgtccggtgacctggttcccctgtcctacattgccggcctcatcaccggccgccccaacgcgcaggccatctcgcccgacggcaggaaggtggacgccgccgaggcgttcaagctcgccggcatcgagggtggcttcttcacgctgaaccccaaggaaggtctcgccatcgtcaatggcacgtccgtggggtcggcgctcgcggccaccgtgatgttcgacgccaacatcctcgccgtcctgtccgaggtgctctcggcggtgttctgcgaggtgatgaacggcaagccggagtacaccgaccacctgacccacaagctgaagcaccaccctgggtcgatcgaggccgccgccatcatggagcacatcctcgccgggagctcgttcatgagccacgccaagaaggtgaacgagatggacccgctgctgaagccgaagcaggacaggtacgcgctccgcacgtcgccgcagtggctcggcccgcagatcgaggtcatccgcgccgccaccaagtccatcgagcgcgaggtcaactccgtgaacgacaacccggtgatcgacgtccaccgcggcaaggcgctccacggcggcaacttccagggcacccccatcggtgtgtccatggacaacgcccgtctcgccatcgccaacatcggcaagctcatgttcgcgcagttctccgagctcgtgaacgagttctacaacaacgggctgacctccaacctggccggcagccgcaacccgagcttggactacgggttcaagggcaccgagatcgccatggcctcctactgctctgagctccagtacctcgccaaccccatcaccaaccatgtccagagcgcggagcagcacaaccaggacgtgaactcgctgggtctcgtctcggccaggaagaccctggaggcggtggacatcctcaagctcatgacctccacctacatcgtcgccctgtgccaggccgtcgaccttcgccacctcgaggagaacatcaagagctccgtcaagaactgcgtcacccaggtggccaagaaggtgctcaccatgaaccccaccggcgacctctccagcgcgcgcttcagcgagaagaacctcctcaccgccatcgaccgcgaggccgtgttcagctatgccgacgacccgtgcagcgccaactacccgctcatgcagaagctccgcgccgtgctcgtcgagcacgccctcaccagcggcgacgccgagcccgaggcctccgtgttctccaagatcaccaagttcgaggaggagctccgctctgcgctgccccgggagatcgaggccgcccgcgtcgccgtcgccaacggcaccgcccccgtcgccaaccggatcgtcgagagccggtcgttcccgctctaccgcttcgtccgcgaggagctcggctgcgtattcctcaccggcgagaagctcaagtcccccggcgaggagtgcaacaaggtgttcctcggcatcagccagggcaagctcatcgaccccatgctcgactgcctcaaggagtggaacggcgagccccttcccatcaactaagccaagatcccatcgccattgccattgccatacacccatcatcgaggaggagaggagactaaaaataaaagaaaacgaaccgcttcgtgtatcttcagacaaaaaagaccctgtattttcttcgttcgttgccgtttggtttatagtgatctcgtgttctttgtgttagctgctctgctcagcttgccagccatggcggcaaagcaagcggcttttctaagatattgtcgctaaactgtattttggggtgaaagtattgctactcgattccatccttaaaaagttgtggtaatagaaatgttttgatcctataatacaatgtcttcagcttaactgtgattcgaattcgtcttcagctcaatgcatcgctttctttgggacttgcaaaattgagttgtcatggactcgtagtgtttgttgatcattgctagtaaggccctgtttagttgcctaaaactttttcccaaaaacatcacatcgaatatttagacacatgtatggagtattaaatatagataaattaaaaattaattgcacagctagggggtaatcgcgagacgaatcttttgagcctaattagtccatgattagccataaatgctacagtaacctatatttattaatgacggattaattaggctcaaaagattcgtctcgcggtttacaggcgagttatgaaattagttttttcattcatatccgaaaatctctttcgatatccggtcaaacgtctgatatgacatttaaaaaatttcttttcacgaactaaagaggctttaagcagtgggcgagcacaaatcaatgggggtttgcgtcaccaatcgccatgagattgccatccacctaccgtttgggacaaaaacttgacaaaggcgcatgacctcatgagcgatgtccaaatcgctcttaagtttcgctcttgggctataatcaaaggtagctacttgactaggcatgatttgctccccttttctgttcatcattgctatgtgttctcttttcaaaaaaaaaaatcattgctatgtgttggtgtgctagtgtggtcactgaaatgaaggtgccataaattaatgccaacaggaggagcaaattaatagaagtggccattttttctctagacctgaaaactaagttcatttcaggtacatgttacttgcaactactatctctcagtactgcttaaaaaaaacaacttttacctatgaatctaaatataacttacatctatatttgtgtataaaaagttttttttttaaggatggaaggagtagagctcagtcacactgatcaactactcgttcctgaccagcatttttaattccattgatgtgta

SEQ ID NO: 767 - DNA, 6445 bp, Oryza sativa
atatcttggaaaggctctatctaagaatgggttttccgagaaagcatgtgacaatagttatagttaattatcattcataacacgagttggtaatggtaaaggatgtcgactaaagttatatacttaaattttaaacttttggttagttaccgacgagtctatttcacaactatggaatccaacaaacatgtttgattatgttcaatcattgcaaatcatgtcatctgtcacacattagctaataacaaaaacaaattgcacctaactcacagcacaaaaattcgctagccgtgcaagatcatttctacttttccttacttttatttctcgttcagggcgaccggccgaaacgtgaaatttgcatatcaatcatttgtcattgtctatatatagatccaattctgatgacattgtgtggtccactcaagcacgtttccatctcccttgatgcaattcactaaacacaaaattcttttcctacttgtgctggtaacaaacaaagtttactagtaacaaatagccaaaccaacggtgaggagagcacaccatctctcactgcatagacacctgtcatccatacatccatctagctaattaacagcttaatcacttgataaacaactcactctgtttcaacatctagtgcttcacgtgatatcaatgtgacattacacctgtctattctcagccctccaacctaataaaccccgaaatacccctacatgattgatccttgatccataatcactcgcttaatattctaataaacagctggtctagattctaaaattacaacatctcaagatctagattgtttaaaagggtttttagcaaccgaagattctaagagaagttgcagctgcgaaaagcacctctaaacacacccaaagttttccaagaaaattcttaagggcattatggtcattcgacacacacatagtaccatctctgtggaagcccagaaagtgctctataaattcagacaaaaatcgtcctctgcacctgcacacatcatcactgggacaaccaaagaaaaagaaaaaaaaagagaaaaaaagagggaacttttcacggccgctgaagcctctgacactccactgtagtgtgtcagtactccggccacctctctcggccgttgctctcccatggcgatgatggcgatgggcgcggcgtcctgggccccgatcccggcgccggcgagggcggcggccgcattctatcccggccgcgatcttgcggcggcgaggcggcggcgtggggcggcggcgaggaggccgttcgtgttcacgccgcgtgccgtgtcggactcccggagctcgcagacgtgcctcgatccggacgccagcacggtacgccgcgatctcgccgccggtgcccaaaaaaattctactcttccagcgctcgcttttttctttgcgttcacgagggagaaaagttcggatccttttgggttgggaaaatcgaagggtcgttcttgggattcgatgtgttgcggttattttactcgacacatttggatgagcgaaatgtgtttgatatgtttcttgtggggattcctgcgagtgcgaagtgtttgtttttttagagtgttttggtgtcgatttctcggtgattctatcagctgttgcgttcagtactctctgtgattcaagaaacggtggaaagatgatggtgacagtatctctagtttagttgttggatgaaatattgacatatctttaacggtggaaaggtgattgttagtgagaaccccataataattaattagtggaggatctatcgtggtccatggcttgaatttaataattggctccagatctgttgtagtacttttgagtttataatttattagattctgtggtagaactagaagtacagaacttggaactcaagagcatttcatctgttatctatatatagtctgatgatgatttgtattattatttttacatccaatttttaatcctgcagagtgttcttgggatcatccttggaggtggtgctgggacaaggctgtatccgctgacaaagaagagggcgaagccggcggtgccgttgggtgctaattacaggctcatagatatcccggtcagcaactgtctgaacagcaatgtgtcgaagatctatgtcctgacacagttcaactccgcgtcgctcaatcgtcacctctcgagggcctatggaaacaacattggtggttacaagaacgaggggtttgttgaagttcttgctgcgcagcagagcccagagaatcctaactggtttcaggtatcttggttaatctgtattaacttgccaaattttttatagtagtactgtattagtttgaattgactcggtaagtggtaatttttgtactatgcaggtactggatgtttctgcttctgtgtattattgaatggtctcgtttagctgcaaagatgcatgaatgccagttaaagtttatactttatagggtacaaagaaaagaaggggatacataattaatatgaacatacaccctgttttacggaacaaaagaaatattagggttaatgtactcctgttgattcactcttccatattttctcacatttatagttaagtgaaactgttcactagtttagatgttccaatgatttctttggaattgcaaactagagttaacattgatagatgagctcttaggttaccaactttcatgttatatggtttctgtatgacaataccttaaggacgctgcctaatttattttgtttctttctgtctcagggtactgcagatgctgtgcgacaatacttatggctatttgaggaacacaatgttatggagtttctcattttggctggagatcacctgtaccgtatggactaccaaaagttcattcaggcccacagagaaacaaatgctgatataaccgttgctgcgctgcccatggatgaagaacgtgctacagcatttggccttatgaagattgatgatgaagggaggatcattgaatttgcagaaaagccaaaaggagagaagttgaaatcaatgatggtaattgatgagtcatccgttgagaccatatgcaacctgatctgttgaagcatacatttcagtgattgtctgcatgttttgatcttgcaggttgacactaccatacttggccttgatactgagagggcaaaggaattgccttacattgctagtatgggaatctatgtttttagcaaagatgtgatgcttaagcttctccgtcaaaatttccctgctgcaaatgactttggaagcgaggttattcctggagcaacagaaattggaatgagggtacgctatgctcttgaaacttgtagcatgtagggaatttttatccttctctcagttcatgctgtaggttttgtgaagtttggtatgtaaactgcagttacatcatttattgtgaaatgttacttctttacttaatttttactttgcatgtttgcttatgctgctaatgtatttgataggtgcaagcttacttatatgatggttactgggaagatattggtactatagaggcattctacaatgccaacttggggataaccaagaaacctgtgccagattttaggtaaggtttacattttgcatggtgaaaacaagttacttttaaaagggtgcatttctgctgaattttcttcctatttttgagcaaacattattgtgtgcagcttctatgaccgttctgccgcaatttatacgcaacctcgatacttgcctccatcaaaagttcttgatgctgatgtgacagacagtgttattggtgaaggttgtgttattagagtaagtatccttttcagatgaattatcatagcgcttccttctatgatctgtggatagtattagatcataacatattaggaccttgagttattacttgttagtcgaacatttctttttcattgcttcaaaacagagaccctaaatttgttgacatgcctttccccctttattttggctagcattgcacaatcaaccattctgtggttggactccggtcctgtatatctgaaggcgcagtgatagaggactctctgctaatgggtgcagactattatgaggtaaaataaaacaaaactatactatattatggtgtattggtgttgtgggaacttaattgtgctttttgttcagacggagacggacaagaaagccctttctgagactggtggcattcccattggtattggaaagaatgcacacatcagaaaagcaataattgacaagaatgctcgtattggagaaaatgttaaggtatttcatatatatttatacttttggttgtcaatctgatgaagtgtgccttctgtattaactgatcaactattcattacttgaaagaaaagagagggacaagcatatttgtttgaatacaaacttggtactttctcatgctttttgttaaaggtggccttttgcaaatgtgcatcttgcatcactggtttgaaagccctttatcattaaaaaatactactatgtcatcatactttttccccctaaattatctttcttttcaaatgctatatgtcttttcttgccatgggtttttgccttgttgagtatggatctttaattatttacttactaagcacaaactgaaaaaatccaggcaacccatatggatcgatttacatattgtttctctcacttttccagagatgaccagttgatactgaactgaacaaaatgatgtgcaatgtttattgcattaattaatgatcaatcttatatgatctgttgcttgtacagataatcaatgtcgacaatatccaagaagcttcaagggagactgatggatacttcatcaaaagtggcattgtcactgtgatcaaggacgccttaatccctagcggaacagtcatataaaggcaaccaatcaccactgtacataaggttctctcaaattctcatatttattctatttagagcgtttggacatcaccaattcaccatgaaatgggaagcgtcttttattttccctcttacaaacaatttctaccaaaattggatcgactgccttgcttaatgctagaatttgcttagtagctggtaagcctcatatttatgcttaaataagtgattcttttgttctgtaatgcaggttgggccttgcagcatatggtgatctgatctccagtgcacatcaagcaatcaacttttaacgctgtggtttattccatgctgccagttcaccaagctctgcatcaacttgcaaggatatcataaaaaaaataaaaaataaaaacaggtgccacttaaaggcaccattttactgttactagtatgagcaaccgctctagagcttagaggtgttgtaagtccgaaaaccgtgtctgaaatgtgggtattttgatgtgtataatctttgtccttttgcatgatcagatttaaatatcctgtgtttatttctacctcttctgcttagatgccatttctttttaatgcttgaatgttccatgcattgctgatgaaagaggagctaatttgtgtcatggattttgtccttgatattcacatatatcaaaccaaaatgctacataagcaacctagatctaagggatcgcctgaatatgatggtgtgatttagaggtttaagtgtggcctgcagtctcagattttggtatcttggtgcatgatgctgttgaccattagcatgcacttcagaaatcagaatttatattttccagtgtgtgatttgatctggcaggaactattcatgcccatattgaaaatagaaacatcaagatggatatgcaaaataacacaatactgattttctacagttgagctatcagtcaaatgaacatttgattgtaaatcattttatagtttgtttcgctaagccctctctttgttggatcaaatttacagatgttgaaagcagctaacatgtaggaatgacatgtcatgattattggctaggaagccactgcaatttgtacttattcatatccactagctggtcatatgcacggctgtgcagtgtttactgacatgaatggtagggttcttcccctcaaaacaaaataaaaatgaatagctgggttctgttcatatcacaaacagaacagaacagcaaacaaaacagcctacctaagatcagtaaccactactcactcatgattctgatccaattctactagatggactgatgtcatatgatgaacccaatgactaactgacaaaaatttcttgtctgatgaaggtaactttcagttcagattgaacagagggagctctgcatagaagggagccgacataaccttcagcacatccttcactgatgacatcgagcttatcgccgccttcaggatctccctcgagcatccgggcttcacaatgttcctcacctgggatatcagtttgacaagcttcaactacaggtactgaattttttttttagctcttatgaagttaacaggttcagattttgttgacaaac

SEQ ID NO: 768 - DNA, 4545 bp, Oryza sativa; identical to SEQ ID NO: 369

SEQ ID NO: 769 - DNA, 6846 bp, Oryza sativa
tataggataaacgctcttcaaaaggtgcttttttaattttttttatgtcacgtcaaacgaccaaccaccggtcacaccatgctaagagacaggtataattcttgaggcagcctacttgccaccctcccaaataatgttatcatagattaggtggacttgaaatgatttggtactcacaaactcatccaaatgtataaatttggatgtcattaagcaagacctcttcatgttcctatgtgttcgatcctctcatgtgtttgatctgttaaattaggatggaacgacgccgacttcattgagcgtcatcttttcatatttacatacatgtatttgatcttataaattgggatgaatttgtgaagcgccaaataattttaggccccctagtcaggcaaaaaagatcctctaagagggtcgcaactcacaagtgggccggctgcaaaattgctaatgcccacgcatcagccggcgttaacattggtgaagtttaccacataagaaaaaatgtcctttggaaggtgttttcaagaaagaaaacactccaaaaacgttatggatatactcaatccgtttattgatagatgactaacttttgaaaacacaatcgggaactgactatccaattgtcgggtgatttctaacaaaaattcacctagattttttctactattatatttacatccaacagactacgaaagaaaatagcaaaattgaatcgggaaatactctatactccagcaacaactgggcccattcgctcggcccggcccacctcctcgcacgccatgcccacgccacgggcgcgcacgcgcagctgaagagagagcacccgcgcgcccacgcggcggcgcgtgcccggcacgcggcggcgcgcgcccccgcggcgaccggaggatctccgctcgaactccctctctctctctctctccaactaaccgcacgtcaccggaggccgccacgtacatgtgttatacattatatatatcagtcgtggtcgagtaggaggtttcttgcagagatcggggttcggcgccggcggcgagttgttgagaggcaaggcaaactcaggcgactgagctaaagaagccgcactagtatgggggtgacgaaggcggaggcggttgccggcgacggcgggaaggtggtggacgacatcgaggcgctcgccgatctcagaaaggttaattctctctgcaaatactcctggttgctcatacttaaatctacctatgaatgagggatcgcatcgatgtcgcagttggagttggacggacaggagtgagaaattattatctctgatctgattcctgttggtatgcactcttgctgtttgtgaaaatgccccagaggatgcatccacaggacacggcgccttcaatatttataagttgattcaatgatgggtttctttcatgtttctttgctgaaaaatcgtgtttagtagagtagtcttctatgtctctattcaaaagaaaagtggcattaagttataggagaaaataaaagggagaagtcgttttgttaattaggagcttctcctttcgataactatgacttaatagttcatttttattatggaacaaagatgagatacaaaacaatagattgtgatcacctcagtttttttgtttgatatcaagtctgacaaactaaggcattacggttctctgctcttgtttgacaaacgaagtctattgtacaatagaagtctgttgtttaatgtctctacttttggtcatctcttgtatggtttagcctagatctcagtttatcttactataggtcgccgatagtacaatatgatttgtttctccgccgtacctaatccaaaatcatatagcttgacattatctgcttcgcatagatgttcgttataagcttcaaattacaaatttcatattgaaagtttagcctcttcttgttggactataatagcgagtccatgtgaacatcatttcttacattaatatacatttcttcacatttgtggctagttattttacttgccctaccattgtcgcatttatttatatttccataactcattttccaatgcttagttgaatgtatcattcactcattcttgtattgtttgtacgtctttgagactttgactgaaaatagtcttagttttgtacctattttatattttgctttatgttttaattattttctttgacatgatgtgcatgcatatttattactaattggtcatgtaacacaggagccagcatggaaaaggtttttgtcccacattggaccaggctttatggtctgtttggcttacctcgatcctggaaatagtaatattctctctctaaatttattttctcacactcatatggtttctcacgcttgacgaattgaaacagtggagactgatctacaagctggtgccaatcacaaatatgaggtacattctctagccttttctatatgacttttcctgccatttatcacagttgtcatgtcttttgttacagcgagaagaaagaaacaattaactgatatgcttcttgatgtgctctttcatatgtttcttagcttctttgggtgattttgattggcctgatctttgcactgattatacaatcattatcggctaatcttggagtggtgacaggtaataaatagacactttcagcacacaattgatttaacatttcagttggaagtagcaagtaatgaatgtcaattgatacagggcgccatcttgctgagctgtgcaagactgaatatccagtatgggtgaaaacctgcttatggctgctagcagaactagctgtgattgcttccgatattccagaaggttggaaatagaatgatagatctaaataaaaaaaagttaatgtttaactgtcacctttgagtttcagttgattaagtttataaactctctcactgatataagtgtacgagcaacacttgcactgattgtatacagtctcttatccactaaacattatgatatgtagcactttttctgagaagaaagcaacaacatctaatctaatatttggtgttttttacacatgtaccttttgtgcagttataggtacaggatttgctttcaaccttttgttccacataccagtgtggaccggggttctcattgctggctctagcacgcttcttcttcttggactgcaaagatatggggtaaccaactatttatgactggatatatgatagatgtctgtataaaatgttttaatgaatgtctaaacatcattgtattgtatttgatcattactgtttggtcattgtaaatggtggtcattacaaatgggtttgttgttgaattgacttgtttgcatttttccttcatctatataactaggtaaggaaactggaggttgtggtcgcgctattggtgtttgtcatggcagggtgcttcttcgtggagatgagcatagtcaagcctccggttaatgaggtccttcaaggattattcatccccaggctcagtgggcccggtgccacaggagactccattgcccttcttggggctcttgtaatgccgtaagcagtcaaacatgcatatatacccccagttgttaatgtgtgcaatgtcttttttgcgtcttaagattcttctagggtagctgtaaacatgcataaggttttcaactctccagtaattacaaatctccacaatggtagttttagtctttttttagattttgacaaaatgcactcttgttaatcataagtgagcattatcagttattaattacaggcacaatctattcttgcactctgccctggtgctgtcgaggaatacacccgcatcagcaaaaggaatgaaggtgatcagatgtccgtgttcttgcattaaaaaagaaatggtactcctagttggctgatacatattccttcattcttttgtactccaggatgtctgtaggttcttcctctttgagagtgggatagctcttttcgtggctctgcttgtcaacattgcaatcatctctgtctccggcactgtatgtaatgcaaccaacctttcaccagaagatgctgtaaaatgcagcgaccttacattggactcctcatccttcctcctcagggtactgcatatatgtgcaaagttcatcaccatttatatttagttgtgttattttcttcacaaaaataaattagtcatgttatcattgaccatataatggtcatttacagaattattatttatttttttttcagaatgtgctaggaaagtcaagtgcgacagtgtacggtgtagcactcttggcttctggacagagctcgaccattactggcacttatgctgggcaatatgttatgcaggtatattttacctgaactctaaccttgtttacaaattaaccaagtactatctgtgaactattttcttaatgaccagttcaagtggtatagtattaaccacgcagtaaactagaagatctccaaaatggtgaaagaaatgaaaaaaagtttgcaatctatcaagcttgaatgtatagtaacagttttttttttccatgtatctacaggggttcctagacatcaaaatgaaacagtggcttcggaacctgatgacacgcagcattgccattgtgcctagcttaatcgtctccatcattggagggtctagtggcgccggtcgtctcatcgtcattgcatcggtacaatcttttactacaaatgaaaatatcagtttgcccataagaacactcattaaaaaaaactgccatacaatcaaccatcttctaattttctcaataattagtaagttatttgctaatcgaaatgcttctttcttcaaaaaatggacggtatgtaatttgttgtacctcattccttctgatcatactgttaaaaagaatcaaaacctaatgcttgttttggtttggctgttacgtttcatacagatgattctatcctttgagctaccatttgctctgatccctcttctcaagttcagcagcagcagcaacaagatgggtgaaaacaagaactccatctatgtaagcactcccccatcaatcaatcaatccttctttctagcttgtccacacatagaaaacaaaaacaaaaaaaatcctggaaaactaataatgcattggtaattaaaacctgcagattgttggattctcctgggtgctggggttcgtcatcatcgggataaacatctacttcctcagcacaaagctggtcggctggatcctccacaacgcgctcccgacattcgccaacgtgctcatcggcatcgtgctgttcccgctcatgctgctctacgtcgtcgccgtgatctacctgacgttcaggaaggacaccgtcaagttcgtgtctcgtcgtgagctgcaggccggcgacgacaccgagaaagcacaggtagccacctgcgtcgccgacgagcacagcaaagagccacccgtgtagtacccttccagaccggttaccggtgttggctggtttttattggatagatgtttaggtccaattttttttatataaaaaatccaatagatgtttaggtccaaatttttgaattcaaaaaccggttagcagtgataaccggctgaaattttggcccatgggagtagattgttgctttttttcttagtgattagttattggcagattggcagaatgttgtagctaggcaatctaattgtatggttagatatttagtcataaatccaagagtgagttttcttggatgcgaggacaaggacaatctaattgtatggttagatatttagtcataaatccaagagtgagttttcttggatgcgaggacaaggacaaatataaatgtaaataaatgcagttaaagtaacaccttgctcaaatataaatgtaaataaatgcagttaaagtaacaccttgctccttgtggacatctatctcttgttgatgccagtgttgtggatgacggaatatggatgtcggacggagatggttccgctaaacgaataatcggagtacgggcgaataatcggaatttgacggaaatttaacgttttggacaaatatatgtacataactcataatagcttattatttttgatagataaatgcatataactacatatatacctactattcttaaataaaaataaggataacatggcattaactcggcatatagtaaaatatatgtctgaacatatagtgataggtttggctcgtaacgcataaaggaaataccaaaagcatgtaacactatataagtgacactaaaacgacgttctgtagctatatattgctaggttacacaactaatgggcagtatcatgggctggctggcagggccttctggccttgtcacatgatttggcccgtttattcggctgattagtcggaaacggctgattaattgctaatgacggtgattatacgtccttaaacgattaatgatcagcgttttgctcattcgtgacggaggggtcggcgccaccgtattaacgcccgaatatacggccgtaccaaccgttatccataacactggttgatgctgaattcatttgggctactgttatgcccaggtcttgctacgtctattgatttccatgtttccttgagatttagatttggttacaagttaaaataatctctagagtttgagtgaagtttgagtgaaccatctcttagacttccatgtttcttgagatttagatttggttacaagttaaaataatctctaatctctagcgtttgagtgaaccttctctttttcttatttttcttgtggctcattaacttttctttaagctttcccgcaaaaaataacgtcttaggtactcttaaatcctgaataggaagctgtgagcaggtataaccaccttgtatcttgagaaatcggacttctcttctcacctt

SEQ ID NO: 770 - DNA, 7756 bp, Oryza sativa
acactatatcgcatccacctaccaagttgttataccatgggtgcaatttactctaaaaaaattactaagttgtcttttctccgcttccccaatttctaaccacttggtttccacacgcatacttatcaaattactaaatgatgcgttttgacaaaaaaaatcatataggaaagttgctttaaaaagcatattaataatattttttactgatatttaattaatcatgcgctaataattgagtagttttgtttcgcgtgaatggaggattagtccccaacctaaggcttgtttggcacaactccaactccaactccatctctgctggagctagagcttagccaaacagtttcagctccacctacaataggagcagagttgggtgaagctctctcacaaaatgaactagagaggtagagttgactttaggcagttccacaactctactccaaacccaactcctgtagctaaatttagaagttggagttctaacaaacaggctcctattttaccgaacacgacataatgtagggatggataacgagccagatcttcttgactcgtgagttggattattaagctcattaaactcgttaacgagctatatcttatatttagtaatttaaaatatactattttatcatatattaacataataattaacaactaataaaaagctcacttaaatacagatagttttgatgtaactactagttaagaaacaatgaatatacgagctagcttttgttaagtttatgagtaaaaaaaggttagcttgactcgacttatcaagattacgagttcaaaccaatccaaaccgagctcactgctggtcgatccgatccgagtcacgagcttcgattttttttcccacccttagatcagtgtaacacagaaagaaacaaatttcttcaacctttctggtcaacgcgtgctcagacttttttttgtgttcttctcttctgacttgtggacccaaatcttctgctcctttttacgtggccatctcgagagcgctcacttcgccacgacgtcaaccctctctcgtctctcttctcctagccgacgcgacgacgacgacgacgtcgtcggtgtcgcctccgcgcgcgcggcgcgctgctcccctgcacgccgccgccgacccacggagaggactccccacccatcccaggtacggcgcctcgccgcgttctcttctccaggttcgctttgcagaactccctaacaagaaccagatccaacccgaccaccggtaacttctccagctccccatttccgatatttttatggcttggattagctttaatttgtgtagtccgtggcgtgggtttaatcatgtctgtgtttgtggatgtcttacgttgatgggaatgggatgacctcatgtcactcatctccattcttttgtatttccctctttcatgttccctgattctgttttcgttgcgtgtcagtgagccgtgaccctgggaaacacgatgttcgttgctctgtcgctctcttgcctgattctccttggctgatttgtttgctagtgtatcggataaaggctgaagcttgcatttcaattagtacccactggcgatttctatattcttgatgccccgttcatgatcaccgattataatgtctttacttccacaccgcccaatttgctctgacgaatatatctttctgaccaaagcagatttccagtgccaatctttatgtacctcaagtcgcatcaattggtagactagagcaagttaggcagaattgctcttctttttcccccaaatgtacacagtgcatctttctttaatccattgtttgctggtcttcttgttcctggaccttatctcctcatgttagtggctgtggttgttgctatcctgttggaagcttttctcatgtgtctccactgggtgtcatattctcggtacttaagcaactgagacggtgccattgcaaagcgtacctataaataagtccacactcttgcattgtctttgcagctccaagtcttgagggttcttgcattgggagagggggagatgagcggcccaatgcaacgctcgtcgcagccacagtttatctctagcgtcgagcggaacaatcaatcgaatggtcctggcactcctcttattgacagcatagatgttgatcagattgttattccagaggtatgttgtatgtgggttttagttcttgattggttctgaacatagcacatgccacaatgttgctaaatcagttgatataggttatgaaaatagcaaaactgtctccatgccaagcatccaagatttacagttaggcccattcttttctttttcaagataaacctcccatgtgcatctgctgtagcaatgtgtacaatatgcagtgtgtagtttcaaacctgaagtgcatgggaggttaaaaatggaaggaaagcaccaacctagtcaatttgttatgctgtctttttaaatatcttgatatttttcacttcaggatgaagaaactaactactggttgttatatgctattggcagaaaaatagttggaagaacctattttcatacatagggcccggatttcttgtctctattgcgtatattgatcctggaaattgtaagatagctggatttgttgttcactcctattaaatgagtattcacagtgatcatgaccaaaagaatctctcatcttgcagttgagacagacctacaggctggagcacagtacaaatatgaggtgcattactacttctcttctttatagctacttcttttatagtacctatcatatcttctttctcataaagcatgtgacccttgaaattgaatgtatgccattcagatatgtcatgcttatctttaacaaagaaccacaaccgttttcttttgttgccagcttctttggatcatacttattgcgtcatgtgctgctcttataattcaatcacttgcagctaggctaggagtcgtgactggtcagtatcatgagccttgcgacacctgtctttgtttaatggagtatcgttatttcctttcacatggacactgctaatcattagttaagcttttccatatgatagggaagcacctggccgagcattgcagagctgaatatccaaaggctacaaatttcatattatggattcttgcggaactagctgtagttgcatgcgacattcctgaaggtaccagagtgtaaaattttgagcttctgttgcatgacttgcgttttgcatttaatgagttgcagatctaattgaagtataaagttcagctgtttcatgatattgcagacagtgttatactagtcctaaagcaaatctgaattgaaaatagcaatttgtgatgtggaaccattcaatttgtgatagggaaaataacaagacatctgcaactatatgcttcatattgcatctacccactatacctaaccagcctccatggttgcttgttcttttcagtaattggaactgcttttgctttgaacatgctctttaaaatccctgtgtggtgtggtgttctgataactggactcagcactctgatgctactgttactacaacaatatggggtaagaacatgtcctgattttatttcacagtatttgggaccagttaatattttcccttaaatttcaatgccaaagaaaaatttagcctttccttttacttgaaatatcgatacagtatgatacttgccactgccatatagcagcacactacttagaggatccttgtcagcacaaattttgaagatcactaacacaattgcattagttaacagacagtgttttgcatttgtctggttcgtgtagttgctcatatcacatatgatttgtttttgtgcaggtccgtaaactggaatttctgatagctattctggtgtcattaatagcaacttgtttcttagttgagcttgggtattctaaaccaaattcttcagaagttgtgaggggcctttttgttcctgaacttaaagggaatggagccacaggtcttgctatctcactacttggtgctatggtgatgccgtgagcttcctgtccaccccttttgtcccaaacatatctttaactttcgacaaaaacattttccatgtattattcttattacaggcataatctttttctccactcagcattggtactatcaagaaaagtgccacggtcagttcatgggatcaaagtaatgtccaacttcctttattgtatccatttattgttattgtgattttgatcttaattactatccttcatgtgcctgaatttatattttctgttctatcctgaaattttgtatatacagtttgagtgtgtccagtcacatgctaaatattatctaagaaatattggcatgcagatgacataaaaataacatcgtcgtgattaaataattaatttatttcgaccaattcaccttcttgcaggaggcatgtagattctatatgattgaaagtgcatttgccctcacgatagcgttcctcattaacatatctatcatatctgttagtggtgctgtctgcgggtcagataatttgagtcctgaagaccagatgaattgcagtgatcttgatcttaacaaagcttcgtttttgttaaaggttggtcaacagttttgtggtattcatattattgtatttgaaattataggatagactgttcattttgagttagaaaatatttatggttttgttatagacagcgttatatgtatcatgtgataagttggacatatgcacctaactgatttatgagatcttattatttgacaaaaacaccttatgaaccttatgtcttctttcgaaggttcctatgttactgctttttccatgtaaattgtgcagaaacaattctgaaattatctttgtcaatttctgtattgtaatttataatctgatccatattattttatatgttgttatagaatgtcctcggaaactggagctcaaagttatttgcagtagccttgttggcgtctggccagagttctacaattacaggaacttatgcgggacaatatgtcatgcaggttatgcacatcttgtactgaagtcctaactttcaactaggaattttagtggtagaccaatatcttgttgtataattacccacggaggtattcatagttatacatataatcactaggaattttagttgagctttttaaagttataaaattgtaaataaattataaaattaggtttgaatgtctgccagcattgctactttggtagaactagtttttcctgttgaatcaagttgcaaaacaatgcaaggaaatacggagattggggcgcaaccatagacatttgcagcttaatcatggtcaattaggttgtggaaaaaaatggatagaggcgataggtagcttagggcactaccttttgcccagtgtcccacatcatgccaatataggttgctgcttccttgcatatttctaaatgttcaaccaagatagtcttactctttactcttcattgttctttttggcctgtaaaggaaaatcagtatttccagatgtatgaaatgtaatcttctaggggctgacatttactgatttcttcatttaggggtttctagatcttcggatgacaccctggatacggaaccttctaactaggtccttggcaattctgccaagtctgattgtttcgataattggaggttcctcagcagctggacagttgattatcattgcatcggtaattgctaaaatttactatttcaaagtataatacattcatccttctgataatctataatgaacttcaatgcacatgagaattaaattgctccatcccatatgtcaacttttaactaatgccttactttattatgcacagatgatactgtcatttgagcttccttttgctctagttccactcctaaaattcacaagcagcaggacaaaaatggggcagcacacaaattcaaaagccgtaagttgttttccctagaatacataaatatatagcagcaatgccactatgacacatctgaaatgtttttttttcctgaatgcagatttctgtgataacatggggaattggttcgtttatcgttgtcatcaacacctacttcctgataacaagctttgtcaagctgcttctccacaacggtctatcgactgtatcccaagtattctccgggatattcggtttcctggggatgctcatatacatggctgcaattctctacctcgttttccggaagaacaggaaagctaccctgccattgctggagggcgattcgacggtccgcatagtaggtcgcgacacggccactgaaggagaaggttctcttggccatctgccccgggaggacatctccagcatgcagcttcctcagcagcgaactgcttctgatctcgattagaaagatggcatacaaatactcaaatcaatcaccaaagaaatataccactgatgataatcatgcagctagtagctacctacatagcccaaagagttagccagctgatccctcaggtattcacctggatcatcctagtgaatactgcatactactaattccacatatatagtgacaataattttgtcttgatatctggtactgccgattgtacacgatggttagctaactgtgatcctgtgacaccaaagcttcttacttagaatcttatacatttcgaatatatgtcctcttgtgcacatgctaaattttcaggaatagcagcagtgcactggctcatgtcattggatatcatcaaaatgccatatctattgaacaatcctaagctccgattgaattttcctctcctgtactcaatccaatttttaatgtctaacgctgtttaacttggatatacgtatgatcatttatcttatttaaattgtcccttaatttttttatacaaatatgaaaaatatacaaggtattagttttagtgataaaataattcataagaaagtaaatgatagttatgttacttttttttaataaattgaatggtcaaatattagtcaacgttgtcaaccattaataacaggaggaagagtagtataaccgtcacctgatctcggtgtccttgaaagacttaaaccggtgactgttataagggtgtaattagctacctcgcaaattcacttataaatcaaacgaagatgttataagtggatttatgagttagccatttacaccatttgtgactgcccgcagcgacgattaagggtgtaagtagctacctcaccaattcacttataaatcaaaataagacgttataattgaattcacgggtttttttttttaacgaatcggcgagccgccaatttcattgaacagataaggagtaaattgtacagtgtaaaaggcaaaaactgaggaccttaggcccgagctagctaagttacaagccaatctcccatatgtcttgcgcttgacaaggctcatgttcttgcctcctctttaatttttgccagtatactgctcgatgaaagcttttttggttggaacattccacggtttctttcgttccaccctttgtgattgctagcgggctggcggaatttacaacaaaggccgggtttagttccccaaattttttttccaaaacatcacatcgaatctttggacacatgcctggagcattaaatatagattaaaaaactaattgcacaattagggggaaatcacgagacgaatcttttgagcctaattagtccatgattagttataagtgctatagtaacctacatgtgctaatgacagattaattaggcttaaaagatttgcctcgcgttttccaggcgagttatgaaat

SEQ ID NO: 771 - DNA, 3624 bp, Oryza sativa
ataaagaaataatgtggctgataggatagcatggatatattcggctgcagcagcccactacttatacgttgtgacactgttggtgtttggtaactacagcgtagggtatcgaaaagtcctaataatatcatgcttttatacttttaatattttctaaatataaagttaaagagaaatatagttaaatatgtgcattatatatatattgaagacaatatctatatatatgtttgccccaacaaattaaagtcaaccgaaccatatcatatagtatatcgtaatgcgctagctatctattggctgtcgtatctagctctagcctcctcatttgcatacgttgtgtagtaattaatttgtctactctactaatatataatctgcaaatacccactattttaacttaaaataatataataacaaaaagtccaagtagtgatcggtgaagtgatcaagactaactgatagattgatagatagataggtgtagatagataacttttattattttttaaattttaaattttaaaaataaatctttgtaaaattcatttttaaaatatgaacctttttgttatgccagcttatttggcgtgacaaaataacacattacgtcacctgcagcggcaatgatagttttgtcctaccatgccagctatattggtgtggttacgctagctagttacacatgactaaataacgttgtcacgtcatttagacccacgtgataatattgtttcgtcacgccttcttgattggtttggtcaaaaagatactgatttaaaaataagttttgaaaagatatgtttttaaaattaaaaactaaaataattttttttaaaaaaaatcgtaggtactccgtagatagatagatgctatatctcaaaacaaaaagttagatataggggcagcttagagataggtacccgctgacacgtgggccacccatccaaaccgtcctatgctataaataatggcgcccccgcggctcaccattgcactccaatccaaaagtataatcaagcaaagcagctcgatcgagtgttcgactgatcaccagttggagctaatcgatcgagagagagagtatgacggtggaagtggaggcggtgaccatggcgaaggaggagcagccggaggaggaggaggtgatcgagaagttggttgagaagatcaccgggctggcggcggccatcggcaagctgccgtcgctgagcccgtcgccggaggtgaacgcgctgttcacggagctggtgatgacctgcatcccgcccagcagcgtggacgtggagcagctgggggcggaggcgcaggacatgcgcggccgcctcatccgcctctgcgccgacgccgagggccacctcgaggcgcactactccgacgtcctcgccgcccacgacaacccgctcgaccacctcgccctcttcccctacttcaacaactacatccagctcgcccagctcgagtacgccctcctcgcccgccacctccccgccgccccgccgccctcccgcctcgccttcctcggctccggcccgctcccgctcagctccctcgtcctcgccgcccgccacctccccgccgcctccttccacaactacgacatctgcgccgacgccaaccgccgcgccagccgcctcgtccgcgccgaccgcgacctgtccgcgcgcatggccttccacacctccgacgtcgcccacgtcaccaccgacctcgccgcctacgacgtcgtgttcctggcggcgctggtgggtatggccgccgaggagaaggcgcgcatggtggagcacctcgggaagcacatggcgcccggcgccgccctggtggtgcggagcgcgcacggcgcccggggattcctgtaccccgtggtggacccggaggagatccgccgcggcggcttcgacgtgctcgccgtgcaccacccggagggcgaggtgatcaactccgtcatcatcgcgcgcaagccgcccgtggcggcgccggcgttggagggaggagacgcgcacgcgcacggccatggcgccgtggtgagccgtccatgccagcgctgcgagatggaggcgagggcgcaccagaagatggaggacatgtccgccatggagaagctgccctcctcgtaggcaggcatcgatgactgcttccatcgcttgctacctcaccagctcacctgataaatcacctcagttactatcgattaatcatttaccatgcattaattaagaagaaaacatatataccataattatctaccagtaaaacaaatctaatagtagtatttaataatctcgttggtaattaactgcagtcatgcatgaatgcatgccatattgcgtcgctatctttttttcccatgatgagactgatgagagagagagagaatatatgtcgctattgagtgttactgcttgattactgtactagtagcttattacaatcaaccattgtctctgttgcgtatttatgagtgtaagtggttaattttctgttgcagcataattaagttacctgtatataatctgatgtgtacgtacgcatactgtctcgatcgatctccggggcttaaaaaggagatcgattaattgatcgaggagcaattataattatgatgcagtcatgtttatagttaatttgcatgtgatcatgaattccatcgtaacgatccgctacttcttaaaaaaacaaagtactctctccgttccaaaatccaagacactgtagacattgtagaactatttttcagatattttataatacaagacatgcatgcatatattcaattgactagcatattctcttcattaaattattatttttgaatccttcactctcatgatctatctattggatatttatatgcaatgatgcatacattgtaccatttcttaaagtgatctaaacgaggggacaataatatactccctccgtccataaatataagaaattttagttggatatgatgtattctattacaacgaatctagatatgaagattgttcagattcgttgtactaggatgtgtcacatccaattaaaatcccttatatttagagacgaaaggagtatggttttttgtcattagattaagggtggttaattatatcttatagtagtatttttgaatgaagagagtaaaaaaaacataaggatgagaatatataggcttattttccattagaatttaggggaaatggaggttacttcatatgaatctggacatcctatttctcatgtttaaatggcttcgtagaaaagaaatttctaagaatttaaatcctccacaaatcctacgaattttctttcatgcaaaggaaccatataaattaagcagccagatactagtcgacaagcctaaatgattggagcagcatccaccaggccaaaatgatttgatttgatcgctcgaaatgtgtgcctgtaactgctagggttactcgatacatgcctttccattaatatctccgttctaaaataaattaacctaggagaaaataaaacctatcccagtacaacgaatctaaacatggacagtcatttgtcgagattgtgtcctagaaaatgtcacatcctctcctaggtaacttttttttgggggagggggagggaatggagggagacaaaaggggtcga

SEQ ID NO: 772 - DNA, 11700 bp, Oryza sativa
gtagttttgtgaaatttactcaaaataaattttgcaaaattatcaagaaagaaggaaacatgagaagggaaaaaaacccaccctcatcctacacatacaggtcttgttacaagaaaatacaaccaaaagcaatctcatccagtcaccctacacatctttattgaaagggtcaccctacacatttggctacttattcttgaaaattaggttattgggttgtgttttagtgggttctctagcctgtgtgtactggttatttaatagttggattagcctttttttaccgatatttataacatttatgtgtgtattataatcttgtaattatatcatactaatatatcacaacaacatagtataaaaccatataatcctaatataacattacaccctctccaatgctaatataacattagaaccaactctaatttttttttctaatgtagaagtatagtcagtgtcaaatgcttttctatgaagatgtgccaacttagcggcggcacatggccccaaaccggagagagaaaaacccattagcacaactttattataacattttttttagctatttatgtgcaaaagtaagttgacaaaaattcgatgatcggtatcatgtgtcaggtatgtgctttgatgattcatcttgttagtgcgtcgcatgcctcatgcccacgcacataaaaaaaaaagaagtatgcccaattcatgttcccttgattttttattcgacatagaatgaagtaaggattatacatgtagtttttaaaatttaaccctaaattacatttactctagactctaaatttctaaagacgaaactaagacaagtccttattgcttaactttagaaacaacttgttttcccaccgggaaaaacttgaaaagagtttgtttgaaaaaaaaaggttgtttttcttttatctgtttttttttgaaataacaggaaaaatcgtttttcgtgaggtggatggagtatccgggatccctgaacaaattgctgcttcacaaaaaaacaaaaaacaaaaaacgtagcaccagtagccgccttttccccatctccactggccgccgccggcgacatcgccggcgccgccgagctccaccgctccgatcccactccgaacagccgagctgcggtttccaaggaaccgcgggcgagccgagcccgacccgttatcagccccgtttttttaacggggcagtgtccaagtccaactccgcctcttccacgcttcggcttccatccaatcatctgcatcgtcgtcgccggcgagcgccatgaggccgacctcccgcatactggccgcgggccacctcctccgcggctcacgctcacgctacgacccctcgccggtcgccgctgccgcccccatattccggcggccgccgaccgtgccgaggcctctcccgagccctctgctcggaggcttcgggccgaattgttgggtttatcccggcgacgggaagtatgccccctttggtcgcctcagctgcttcatgtcggactccacctacccgccgcctccccgcgatgtggtaacttgtggttactggcttactgcattgtgcttattgcatttggtttagtttcgatttggggatggttagaggcagtagtggttgattatgtattttgtattgtatcaatacttcagtcaaacaagcgagtttcctagcaaaacagtcggctgtagactgtagtagatgtgattagttactagtttgaccgatacaggaacttaaaaaaggattattaagcattgtggatggcattgctgggcgcatttggttttgtttcagtgttattctcagtccttgcaaaaggataaatttatcagaaatttactatacccttgtttcctttgtcattgctgacattcgtgcgttcaagttgatatttgttatgcttctgatgattttttcagacttaatccatcagatcacaaaataaagtacaaacacgcttactcacattttttcatatatatgattacaagcaataatatttgctacgcttgtgatgattctgtcaagcaattttttggtatttaaaatgcattgttttcatctttattaaatgttcttcaagtatctcacggttgatttcaactctagtaatcaatatccaatacagaaaattgagtctgagtttggttacttggctctgttgttttcctttgtactatgaaaggactcatttgttgagtttgtttttttgtgattcttgccatgtttgcagagaggacatgcattttccacatctgccaatgctgtggcagttgggaaatcatctgatgacaaagtgaagaaagatatctccaaaaaggatgttgatgatcagatagcagatacacagatactgaaaaaccttgggaaatacttattgttgaatgatagcccggatttccgcttcaggcttatattgtcattgggcctcttagttggggcaaaggtaatgctacacctgaaagtggtaacccatatgagcagagtattttgtggctaagataaacctgcagcctaattctgttgttaagatatttcttttgttattaattagtcattaatgaataataacaaggtgcacattatggcaattccttataagctgccacttatctcatgatagagtaccattgaccattatgctggattgagatcaatactaatcttcctggctggagttctatacatattcacttcttattctgcagtgacattttttacttatagaaggaatcattttggcataatatgatgcaatctagtagctagatatggcctatctgttggatgtatatcctcaaaatatttttgccaagttccgcttgttagatacacaactattttcaagtactgttgtcaaatcaaaggaataattatgcaccttcatttagggcatataagaaatgataaccacagaagttggctgttattacagtttacatggaactttcaacttatttatctgaccgttttcatttataatgaacaccaggttataaatgttcaagtgcctttcttgtttaagcttgctgtcgattggcttgcagcccttgctggtgctgaaacttcacttgcatcattcacagaggctaatgctaccctattggctctctttgcaagcccagcagctgttctgattggatatggaattgcacgatcgggagtatcagcctgtacaggtaaactctttttggttagaaaaaaaagcatggttgtttctttccctgaaaaaatgagttcctttcgtgagcttggagcaacatgcattgccaggcccctctttgaaatatatactgattctactgatttattcgtcgatttctgttgccagaactgcgaaatgctgtcttttctaaagtgacattgagagccatccgttcagtctccagtacggtaactattgaaatttccttttttattccaatgttaccactcatttgtcatgtttttccaaccatctactaaattcctctattatctagatgttccagcacattatgatttatgaatcttttgtttatctcaagttttatttctttctacgcattgatgtacttgtcttatttatgtagtgttgctagtattgtaaacagtactttccacaacatttatatattaaaaaaattaaattcatggaaaaaaaagcttgagaaaaaatcattaaaaaatagctattactatcttgacatctgcatcctcatctagctgttcattgactgttgatcatgctactggcccgatgtgcactcccatctgtaatgactatgataattctttatcattttctgtcatttttaatcatatggaactgtttatgctaataaagctacatgctcctttaggtagtgtttggtttggggacgaagtgggatgggtcagacctatcctagttttgtgggatgggatggttccagttgtctgtttggtttatggtatgggatggttatagttttttgtttggtagaagggattgaggtgggatgggatggacggatttgtactcaccgttagtgccgtctaggggcagaggcactcggcggcgcccggatctgagaggaccggcggcggcgcttgcgaaggtggcggcggcggtcgtagacgaggcagaggtggcggagtttgtggagatggcggtcacggtgctcgtggaggtggcggcagtcatggaccaagcggaggaggcgccgggcgcggaggcgaggcggcggctggatctgagtggagtggcggcggtgctagcggaggtggcggtcacggatgagcggcggcactcgtggaggcggcggcggcggccgtggaggcgaggcggcgctcgtggacgcgcggaggtggtggtcgcgggcaagcggcggcgctcatggaggcggcggcggtcgcggacgaggcagaggcggcggcgctcaaggaggcggcggcggcggagaaagacgtgtggaggtggcggcgggtgtggacgaggcggcgacgctcgtgggcgcccggcggagctcgcgaaggtggtggatggcgcggtgacgccgtcgctcgtcccaggtgggacgagtttgtccgccagtttttggcggatcggttggtcccggatctgagaggaatattcctctccagggaccaacccatcccacccacccctaaaccaaacacccctaaaagtgggttcgtcccatcccatcccatcccatccttgcaaccaaacactaccttactggttaaattatgggttatcttaccttctgagctcttgctgttgcaggtattttcgcacttgcatgagcttgatcttcgttatcatctaaggtacttctagaaaatgcctcctattcatcttatatgtttgtttatcttaaatttatcaaatgatatatttccgttaatgcacacatgcacaatacaatatatagaaaagcatcacagttaatgtaggtggcttacaagttgtagcaaataattgcaaggaattgccaaattaggtagcttgactgcatgtatatatttcagcatttacgcatgggagatgatgagaaacctagtctagggctgcactattttggtggttatagcctatatcccactttgattcttctgaaaattggtgtggaaacaagttataagaaacaagcaaataatcagatatttcatgagttttagaactggaaagttgaaaattatctgagctcttatatgcctttacctggcttctatattttcagccggcaaactggtgccctaaatcgcataattgatcgaggtagtcgtgcgataaattacatccttacagtgatggtgttcaatgttgttcccacaatattggaggtactcagattattgtcattgactgttatatcccatcaactatgcatatacgcgcaatgttggtgtttctaactttccgtaatgtatgccagtcacattttacatttttgtctgatgtgtgccttctgttttttttctttccatttacagattggtatggtgtcaagtatacttgcatacaaatttggttccacctttgcttggattacttcagtttctgttgctacttatattgctttcaccttggctgtgacgcaggtgtgaatgatgtgctctatcagaccgtgtctgtcatccatgcatagtctaacaagattttttgctgtttttttgtcactaatgccttgactcgtaatgcattattatgacagtggcggaccaaattcaggacagccatgaataaagctgataacgcttctagcacagtggcagttgactcccttctgaactatgaggtaataccatgattttcaattggcctggcatctagtctatgttcttaagctttcatattctaattgtattaacctttttttttctaacttcctttattgggccagactgtcaagtacttcaacaatgaacaatttgaagttgagaagtatgacaaatatttaaagagtgagtacatatataatgttcattctgggaagaaaccttgttaacgtgtagacatgcatatgttactcgatacacttttttttgaaagatatactctatgcatttaattcactggttttaatgttattttcatcttctataaaaactaccaaaaaaacttatattgaggcatgaaatacatgtggaaaatgttttccatgagaaacagtagggttgatattgcatcttggattttttttttcaatcttcacaaacaattaggagcttgtacacattgatttatcaagtgcttagttatatgctatgtaaatctgatgaatcctagctgacatgttgctttggcatatatcgtaaattggtttataaaatttgatctattaattactatttctttttcacaatttggtcagagtatgaggatgctgcactgaaaacccaaagtagccttgcctacctgaactttggacaaaatatcatatttagctcggctttatccacggctatggttttgagttcatacggtgtaatgagtggtgctctgactgtcggtgatttggtaattttttatgacatccgcttatatattatttgatgcaagtatttcttatcccgttttgacatgttcggttagcaccatatccatttcatacagtggcaaagcatgttgttgcaatattatgtttattttatagtcaggaaggttgtttaagtgaaaagggctaactggaaagttttgatcatatgctactcctttagagtgtcaaattgattatttgccactcatgtttctatgacatgtagccccagggtccatgtatcaaaggcagagcggtggcaaatcatcaaatgccacttcgaggggtgtcaaatgatcattgattatgaactaattatgtggatttggaacaatagttaattttgaaccatgaaccatcagttccagatgttgccagttttctgcttttcttctttatttttgactgatttttattaatttgattaaattttgatatctaggttatggttaatggtcttctattccaactttctttgcctctgaacttccttggaagtgtctatcgagaatctaggcaaagcctgattgacatgaagtctatgtttcaattgcttgaggtaaaaacttcgtgactatctgttgggggcctaaatggcttgcagtttcagtttcatcctttcacaaccccagaaacttcattgctgttatttcactttgttcaggaaaaacctggaataaaggatgaaccacatgcacagcctttgcagttcaagggaggacgcattgaatttgagaacgtgcattttgggtaaattttgcgttctgtttacttattacatgcttgtaccacttccttaaaaagtcacgtctctcagagcatctgaacaccaaagtgaaatattgaagcactcctaacatttatctccgtagagatggaatttctttccttgttttgctcaagttaatttgttatagtggttctctttgtttgtgctctcctgtaatatttaaattttatcttgaccatcgcctcaattctcaatcaagttcaaataggtaaaatattctcatgttgttattttttaccatctggcatctgagtaaaacagtatcagatactgctgccttagggatctacgttgctgtcacgatttgaatttgaacaacctttaattacctcatatgtgggtcaacaatttatgtgcatattgggatgtaaatgactggcaatatatcattatggaatctatcaaagcactaagtacaattaagcaaattttatgactatctattatgtagtctaacttgtaaagtagacttatctgagttaatgttgtagtttacctgaaggaactgatttcttccaggtacgtaccagaaaggaagattcttaagggtgccacgttcactgtacctgcaggaaagagtgttgcaatcgttggaactagtggcagcggtaaaactttttttttgtcaaattgcatctaccaattgtttaacttgactcaaaagttgaaggcgtgtatgagttctcccatggtcgtatcagcaaattgttttgttaaaaagaggatgggctttttggtgtttcccgggctccccccttctattaaagagtagcacaagccaatacttccatatttttttccatgccatggcaaagagagaaaagttattaatgaaggatatcaagttttctagcaatggatgttttcaaatactaattaaagcctgcttggcctacctatactgaacaacaataagctttgggtgtatattgtaattgttattttcctagaaaaatgtttgcctttttaatatccaacaggggctgtctcttaaggctttaatctgaattttgggttaactaaaaaaaattaggggttaggtgttctctttggtctataatttggacaaacatgcttatggtctgataaggtcatttcaaataaccatctggcatggttgtacgttttgtctatttatgtctgattcaaggctgactatagtgatttttttggggttgtatggaatgagatatcttgttttatcaatattagcaaaattcaaatttatgtgatcaacgaacaattcattaactgtattcctctacaggaaagtcaaccatacttaggcttctcttcagattttttgactcctcttcaggatctgtaagaacaaagaacgatctatttccattttgattccctgatgatgaaattgatatccgttttatagcatgtatatcttcagatgtgtatcaagcttgccattcttgtgatgccttttgtttgatctttgcagattcgaatagatgggcaagatatccgagaggtgacactggatagtctccggaagtgtattggtgttgtaccgcaagatacggttagctatctactgctctaaatctgtcaatgctgcattacttttcttgtcttattgaatttactatgctaaatggataaagcatgtagactatacacaattggaacattctggtgcccttgtgcaactttagttagcatatgtaaagttgttgagtaaatagaagtagctctatcaacatgcttttcacatatcagttaggagttaccacagttcactccaagagctcagtagctcacactgttaatgcattatccaatgcaggtactttttaatgacacaattaagcataatatacaatatgggcggttatcagcaacagatgaggaggtactgtgttctaccaatacatttacattatgaagttatagtactccccccataaatcccttatattttgggacggagggagtagggtcatttgaccttgttcaagctaaagtttatttgcgtacaggtttatgacgttgcccgccgggctgctattcatgatacaattatgaactttcctgacaagtacaacacagttgtgggagagcgaggattaaaggtgagatgcagtgtcttatgacatgccaaatccagaatagtcagaacctgttggtcctagcaataatgtctcaaaatctgtgattttacttcctttgcagttaagcggtggggagaaacaacgagtatcaattgctcgtgtattcttgaaggaaccttccattctgtaattccctctttccattttagccttaaaaagctttagattcagcgttgtctgactagcattaccatgctttagcaattgagcaagtggctgttttttattgttcctatgcaagcccttgtatgaagttaacatgtcatggtgatggtgtgccaaatggtcagagtgaaccctgctaaatctgaattatttcacactgttaacaaacactaattttgcaaaagatgagtttactgcattcctccctttgcttattttttttgttatctaatttataccagattgtgtgatgaagctacaagcgctcttgatagcaccaccgaagcgtcaattttaaattctctgaagactttgtccgttgaccgtacctctatctttattgcacatcgactgacaactgcaatgcaatgtgatgaggtatgcatgttcatgcaaatacattagaacaaaaaaacctgcaacttcattttgtgaaagtaatatgatttattgaactaaaaatagggattcagagtaatgtatcagttaacagcaacagattttcttttgcatcgattcaagaaatcgatagttaccatcatgggctagatctcaattatagctgatttatcatttgttcatatgtttgagctacagagctttccattatactcgatactgatgaatacttgtttgatgacacttcaatgattcttttataaatcttgtttcaaaatttgtattttcagattattgttttggagaatggggaggtagtggaacaaggaccacatgattttctgctgtcaaagggtggccgatatgctgaattgtggtcacagcagaataacagtgatgccatcgatgctgccgcggttagcttagaggtttcatagactatatacataattcccttttgcaagggaaaatgcaaaccatatttgaatgaaagaaggcttccccatatctgcattgtaaattgaatggttaggtttttagatatcggggaacagaaatttatagcttaggagcaaataactccgtttgaaagaaagccaggaggcaaaattttcctctttgaggaaacacccaacagttcgacatgtttccatgatgtaagcattttttttactaatccaagtaaatattttttcccactaaatcctatgaccgtgatctgatcgaggactgttgtcaaagccttgtggctgtggtggtgactggtgaggtatcatctcatgctacgtttgatatttgaggactgaggtgactactacaaatactgctgatgtgtgaatgtttatatgcttaactttttgtttaccgcaggtatgtgagatcaaaacttattttatgtaaatattttggtcgttgccaaggtaagaatgaatttatgaatgctgcctcctttttggatgaaaattagaagatgttgatgttccctccagcagattgtgttagtctttgagctttagctttaacattgttactacctgcagatataaagaaacggcaaggttttgtgagatactaataaaacactaaatttacaaatacggccatccccatatattatgcggcgtgacatcatgcaaatttatgtggtgtatgtattatcagataaattcttttatgttcatttccagctcgatttacggctgaacagtgaatataatacctggcttggtagcgaggaagtaatacgcatgaggtaaagtatccgccaaaattcgaacttttacaacacaaggcatggtgctccgacatgataataacttttgtagcgttcggcagccatcgatgctgttaaatatcacggcaaagctgcagcaaattgagctgctgcagccgtagcgctgcggcaaaattgcccttcgaagaagcccatagatactgacttgtcctgtctgaatgtatattgtttgagattaagcgaatagagtagtttaattaatccaggatgctcatatactcattgttttgctttttttttatttccttggatatattggtgtcttgcattttttttaataatatatgcctagcctatgcttaagagcagacaaggaacattggacattccccaatgggaacattattctatgtcatctgctaggtgcctcctatgaccttcgtactcgtagcatgtgacagccagatgtattgt

SEQ ID NO: 773 - DNA, 5621 bp, Oryza sativa
ttaaaattaatatcattggattgacattcaaatttactttaagatggttataaatttgttacaataaatcttatagtatatgaaaaattttaagtgagaaattttagatcaagtattagttttgaagactataccaagtttgatcatgtcttataggagtattatggaatggaggaagtatatttgtatatacttactgtacgtagttagaaattgtttttttaagagagaatagctactttagtccctaaaatttctctgtaggatcagtttagtccctaaccttttaaatggtccaaagaaatccttaacctttgtcataaggcctagaatagtccttgggtctaccaaaatcatcatatggatatgccatgtcatcattcatgcaaatctatgatgaattgtctaatatacccttacgtatatcatagaaaaataaatataagggtgaattagacataaccataggaaaaaaatacttcttttttcacccttttgaggtatatttttgctcttacatgtaccatatattttttaacttttttcttttgttttttattttcctatgcgtaagggtaaattggacaaatcatatagattttgcatagaaatgtgacatggcatgtccatgtggcgattttggtgggaccaaggactatattagcccacatgacaaatttaaaggacttgtttggatgcgattttcgtgggaccaaggactatattagcccatatgacaaatttaaaggacttatttggacaatataaaaaattaatgactaaaatgacccaggaacaaaattttaaggaccatattagctattctcctttttattttttaatatgccttcatgtccgtgccaaagaaaagacgagaaggaaagcggatgggggccgcgtgggggttccacgtcatctgtctggtcggtgggcccgacaatccgtaattaaattaccaaactgcccctcctagccaaagccacctcatcctcctcttcatatctctcgcctcttccacgcgagaacgcatcctaccccccgttctctcctccccatctccaacgcacgcacgcgccatcaccaccacctcgacgccggcggcgacgaccacggcgacggcaacggcggcggcggcagagaagccctcctcatccccaaggttagcgcctcatcgccgcatccccatcccctttcccaccacctcttcctacgatggattcgtcgtccccaccgagagaccagatcaacctctgctcctctctcgttcgttccacgaatctgctcttcgctcgccgcgggtttccctggggtcattccctgttgctgttattgtttcggattttggagcgctagtttttttttttttgtttaggatggaatattgtttcatggaggaggaggagaaatcaggggagcggcggttacgggtcacgggattgggttgttcgactcgaggttacgggttgctactgcgggattgggttgttcgagtggaggtgtggggtctcgcttcgattcgcttctccgtccatttgatcgggggagagaaaaatttttcaaaatcggtcgaatcacgagtccctgtctccaattgcggtgttacggggtgatgatagggatcgatttttggtcgtttcctccttgggttcttcctaacactacagattcgattggtctggagtaggtttcaactttcgtcagccacaaactgtttgtccgcgagcacggcgtcattgaattggcgaaataaatcgatcaatcaatcaatcagcgttggtccctgaccagtccgtcctcgtgtccaatgaaaagcttccgatggatggatggattggttggaaaatctcattacgatagctctggagtgcttcattagtttcattatattgtccttttggatttgtggacatacactctaatgtaggttatcgtaaacatgaatgaatgccgattagcttgctcccttggtggtgttcccctcttgtgctttcgctgtaaccagcgattgccggttgccttcggttaggtagagagaacttgatctgtttgagggtattttgatttacgaagtacctacttcaatcttgtgacgtttgtttgcaatcatgtgctgaatgtctagttatgtttagggggaccttcttgttgttggattagtgcgacttaattaatcttccctttcgtgatactgtcacttttagttggaaaagactgccaggtgccagctaactgttcttgtactgccagcacgacaattctagtgctctccttctgcattcagttttatggtttttttatttcctgttttgttgtgcttttttaatacatcttgaaagctttagcctgactaagaaaatggtttcattatttgcaatgcttatattatatttgcactagcaagaactatgcacttgctatatttgttgagcaaagagacattggcaccttctaaaaacgaacatatttacttctattcattatatcctttggccaacctttttgtacctgctactgttgtctcctggttaggaaggtggtactgatgcacatttttttaatgtgccgcttaacaaaaggctactcattgttacctggcataagtaccataaaagtacgctctgccatggcacggagattttttacttgtaaacagtgttgcctatgttatatatgtttgatgttttaacttcgttattcattcatgttaagaatgttcatgccaccttttactttatgaagtgctgttcagtttttttcctcccccagtgacacaagaaaggattcttatcactagcttttcgcactatttctaccaggaaccttatgttaacatgttttctcagagcatgagaagtaaatatagcatcatctttgtacttgtgtattgacatgattcttttccccctagatggacagccataactcagcacctccccagattgctgaagtgagaatggacatctcatcatctacttctgtagcagctgggaacaaagtttgcagaggtgctgcttgtgacttttctgattccagtaatagctcaaaagatgcaagggagagaatggcgtcaatgaggaagctcattattgctgtgatcctttgcatcatattcatggcggtcgaagtggttggaggtatcaaagcaaacagtttggcaatcttgactgatgcagcccatctcctttcggatgttgcggcctttgccatatctttgttctctctttgggcagctggatgggaagctacaccacagcagtcatatgggtttttccgtatagaaattcttggtgccctggtttctattcagctcatatggctccttgctggtattcttgtctatgaagctattgtaaggctcattaatgaaagtggtgaggtccagggctccctcatgtttgctgtctcagcatttggcttatttgttaacatcataatggctgtcttgcttggtcatgaccatggacatggacacggacatggtcatgggcatggacattcccatgaccatgatcatggtggttctgaccatgaccatcaccaccatgaagatcaagagcatggccatgtacatcaccacgaagatggccatggtaattcaattaccgtcaatctccatcaccatccaggcactggacaccaccaccatgatgctgaggaaccattgctcaagagtgatgctggttgtgacagcacccaatctggtgccaaggatgccaagaaggctcgtcgtaatatcaatgtacacagtgcttatctgcatgtgcttggggattcaatccagagcatcggtgtgatgattggaggggctatcatctggtacaagcccgagtggaagattattgatctcatctgcaccctcatcttctccgtgatcgtactcttcaccacaatcaagatgctgcgcaacatccttgaggtcctgatggagagcacgccccgcgagatcgatgccaccagccttgagaatggcctccgcgacatggacggtgtggttgcagtacatgagctgcacatctgggccataacggtggggaaggttctcctggcgtgccatgtgacaatcactcaggacgcagacgctgatcaaatgctggacaaggtgattgggtacatcaagtctgagtacaacatcagccatgtgaccattcagattgagcgcgagtaggcttgaccgcttgagacaggtaggtagtgttgatgatagaacggatcatcttcatctcatctcatgggaccaacttatcaggaacctgtttcactggttttatgcagttactgttagctctgcagtgcaaatcagatcagcagagtccaacaattcctgcaggttcatctgaatgttagcttctgatgctgtttattactataagtacgtgttattagtactatcttagtcaattaggtgagttgatgttaatcagtttcgtagtcggttgtattcacatgggtgcagttttcagacaagttttcaggcacctgtgagtacgtcaacctgccttctgcgtctgtagtctagcgcccagccgtactagtttttatgtaaatctgcactggcatgggaaataataaccaagtttcgtttggccttataatgatctgcttcgagcttttttgtttcttacattgcaaacctactacttgtactaaataattcgtgtgcgtttgctggagtgggtttttttttttcacaactcttatgtgagcataacatatgctcgtttgcttctcactctaggagtaccatcattcaactagtcacagaaaatcaattgatcattacaaataaatctggtaagcgtttatttatccaaatggcatatggaactccacacaaatgtttggtggttggttttttcaagaaatcacaaaagaaatgaaattatatgtcctgttaaaggttgttatgtgttgttcgttctcgttaagcaggaatgttgtttttctttctatgcattgttcgtcctggttaagcaggaatgctgtttttcttcctactactttaaaaacgtagtcgtcttcctttcaactctttattgtacgtaggatggctttttactactttaaaaacatagtcatcctccttttgactccttatcgtgcataggatggtggtttttactactttatgatgtcgcctagaggggtgaatagacgatttttaaaataaatgtggaagctaaaacaaaacagggtcggattgtctgatatcaggtcggatagtcctatgtgatcggattgtctgaaatgagatcagactatctgacctgcacaacaacaaaaacaaacaagaaacaacctaaaagctctagatccaatccacacgtaaggaggtgagctcaaccaacaacaatattagcatggcacaaagcaatgcaacaagaaggtaaagagagataggatatcactgaggtttacgcgacgatgtatttcccggagttcaaatccttgaggggattctagtctccgttgaggggctcgcaaagagccgggtctttttcaaccctatcctcgtgaggttgcacaaatgcactcctccttccactaagggtatctctttccttgcggaggcgagatccggccttcacaaacttctcttggccaaccacacgtagatcggtggc

SEQ ID NO: 774 - DNA, 3013 bp, Oryza sativa; identical to SEQ ID NO: 473

SEQ ID NO: 775 - DNA, 5357 bp, Oryza sativa
tctatgacaatatccagactaataagtattcctatatatgctaatatgctatcattctgtttgacggttcatgtatgctaagaatctgttagtcatgctctttgtcggatgtatgattcgtgggttgccactttatggtctaatacattgattacattctcatgacttgtgagtttgatggtttttgtgccatgtactgatatattcttctactatgcagttgacttgttgaagcctggtgctacagtgatcatgcgcaatgccaaaatcgacatgttcaaaggctcaatgaggcttgcggtggacaagtgggggcgtatagaggctacagaacctgccagctttactgttaaggaggacaacaacttgtcactagtagagtatgagttggttaacgtgaccgagtaattgtcgttgattcgccccttcccctgccataacaaggaagcatgatgactgagaatattatgaaccctttgcctaagcatgtttatttggtatggtggtagtagataagatcaaagatcgaactgaatttatccatggtatgcgtctactaagtggtgattcctcttgttacctgttgctgcctgtattgctgctgtgatggaacaagctcagcagggtgacatgttgctagagtaccagttatcaatggagttaattgttgcaaatcctacattggtgaatattgccatattgcctttttgtgaccgctgtaatatttgtgtgttgtctccagaatgtcaagcttgagctatgtcaaatgcttgcttaagttttaaccattcctgacacgtttaacagcgaattgccagtggtataaacaacgtttgccgcaacaatctcccgccaagaaaaggaaaagaaactcttggttgttagtgacacgcctataaaaagccatgcttacgtggattacacagagtttcatcaaaacaaccgatcaaacgaggtgaaggtaaacaaattgaattgatcaaacgacgacgttgaaggtaaaccaaagatggcagaccccgccggcgccggcggcgagcaggaggcgccgtcggtggaggcggcgttcgcggggcagccgccgccgccgtggtggcagcaggtgacggtgcgggcggtggccgtgagcgtggtgctcggcacgctgttcagcttcatggcgatgcggaccggcctcaccgccggcttcgtgccgtcgttcaacatgtcggcgagcctcctcagcttcttcatcatcaagtcgtggacgcggctgatggcacgctgcggcgtcgcctcccagcccttcacaaggcaggagaacgtcgtggtgcagacatgcgtgatctcctgcgccacattgtcaatctacggtaggtacccgcactgtcctcctcccccgtgtgtcctctagcaaataaccacgtttttttctatcacgtccgatggtcggttgatcgatcgatcgttggacgttggtctcctacgtttgtttttttgatgatgagggggatgtacgtctgtgcaggtggtttcacgagctacctgctggcgatgaacgagacggtggccaaggcggccggcggaggaacggacggccggaatgtgtacacgttgcacaccgggaagatcgtggccttcctcttcctcgtcaccttctccagcttgttctgcactctgccgctgaggaatgtgcgtataatcgattcatcatcgcaaattcaccctagccatttcacatctatttaacacacacacacacacacacacacacacagagggagtaacatttaaacaaaatttaatctctgattaaccaaccactcccctgttcatttcttggcagacaatgatcgtggactacaagctgatatacccatctggttcagccgttgccggcatcgtcaacagcttccacacacccaagggagcaacaaaagccaagtaaattaacatttctcatgtcagttcatgcaaaactttcgcaaagattaaaatcatcaaccggcatgttcaattcagattgcaggtcaatgcgatgttcaaatccgtggccgggagcttcgcgtgggcgttcttccagtggttctacacggggggagacgggtgcgggttccatgctttcccgctgttcgggctcgaggcgtacaaggagaagttctacttcgacttctcggcgagcctcgtcggcgtcggcatgatctgcccccacctgatcaacttctccatgctccttgggtccatctcctcttccgggttcatctggcccgcgttacaggcgaagcaaggggaatggtacaccgatccttccccgaccagcttcaagggaatcaatggatacaaggttagaaacagacatatgttgattgttgtgatttctgaatggcaatcgccaatcgcttgttagtaccttgtccgttcctttttacctgtcgtttttaacgtcggtatgccacctttgtacatgtttggtcatcatggtatggaaatatttttcaccaaaattgtacttcctgtgataataagtatatttgatttttagaataagatatgaaattttcaactttgatcaaatcttgttttaaatgttaaatattcataagtggagggagtaattttcttttcttttttttaatgaatcggctcaagaggcacaaatttcattgaataaagcacatcaaaatttttatacaggtataaaataaaactttgcacagaaaattaacccataatctcggaaagatgctttgctcccatcaaggttaggtttttgcctcttaatctttgtgttcaaagttatcgctgacagctccttgcactggaacatttttttggtttctcttcttccaaattttctatggtagtttgtttcgacgtgacaaatcttaatacttttgtgcgagttattatctaagaacgaagagagttattatcggcgagatctctctttacattctctctttacatttcactgaccattttgtgcttggatcgaacatgcaggtgcccatgggggtatccatggtgctcggggattgcctgttccagctaggcgccatcactgtcaaggcggtgcagcactaccgcaaggggcggcaggagcagaagctcgccgtcgatggcgcggccgatgacggcggcggcggctgtgtccccgacgacgacgacgagaacaagtggcacgccacgtacgacgagcggcgcaggaaccaggtgttcctgagcgacgggatccccgaccaattcgccgtcgccgggtacgtcgcgctggcggcgctctcgacggcgctggtgccgcgcatcttcccgcagatccggtaccaccacgtcgccgtctgctacgcggtggcgccgctcctggcgttctgcaactcgtacacctccgggctgatggactggtcgctggcgacggtgtacgggaagctcgccatcttcgtggtcggcgcgtcggtcggcgccgcgtcgggcggcgtgatcgccgggctcgccgcgtgcggcgtcatgatggtggtcatcggcgacgccgcggagctgatgcacgacttcaagacggcgtacctgacgctcacctcgccggtgtccatgttcgccagccaggcgatcggcacggcgctcggctgcgtcgtcaacccggccgtcttcctcgcgttccggtggctcgccggcgcggaacacccgccgggcgaccccaggtcggcgtacgcggcgccgatggccgtcgcctaccgcggcatcgccgtgctcggcgtggagggcgtcggcaccctgccgaggcacgccatcgcgctgtgcgccgcctgcttcgccgcggcggtgttcctggacacggcgggggcggcggcgagggcggcgcggtggagggtggggggctgggtgccgaacccgatggccatggcgatcccgttcttcgtcgggccgacgttcgccatcgacatgtgcgtcggcagcctgctgctgatggcgtggcggagggcggacaggcagggcgccgcgacgctggccgtcgtggtggcgtccgggctcatctgcggagaagggctgtggacgctgccgtcggcggtgctcgccatgctcaaggtgcagccgcccatctgcatgaagttcctctccagaagccagatccaggaggtgcggcagcacttcgtgctcggcgccgcggatatccagcccgcggtgacgctgacgcatcatcatcatcaatgatataatatactggagtactcatcatcagcttgtaaattggcgggaatgatcatattgttttgaattgtgagtaggagcactatgcctgctgaaaagtgagaagtgaaaactgctggtgttgaacaaatcaagcacatgaaaacgaaaacctaatatggaccagggactacctatacatttgtcaacaaattttctcctaaaaatttgacatatataattatagtacaattgtagtgtaattatactgtaacttatatgtaattacactgtaactcgcatgtaactacagtgtaacttatatgtaagtttcacataattttgaatcgttagatctattacaaaatttgttttggtgaggaataaaacaaatcatagcacacacatatgagaaataatttgttcccacgacctccattttaccgaaataacatgttacggagagatttttgaaagttacatacaagttacactatagttacagtgtaattacatgcaacttacagtgtaattacactacgattgtactgtaattacatatgtcaaatttttgggaaaaaaattgtcgacaaatatatagcaaaatcgtatggaccaactaccaaatcttagtggttttcagttggcacccatggttggtccaaacaatgaaggcaaattttgctacaggacacttcgacttcgtggaaaacatccataagtgagttcggacggtgtcctgagactaaaaccacaaagtcaaagtgtcctatagcaaaatttgccaaaaaggaaatagagggtcctaagaaaatgaaacgccaacaaaaggttttaacataataaaaaaatcaactgatatcaaaacctcaccaaagttatcagagcttcatatgaggcttcaatatggattagaacaaaccaaacacacctcagaagcatatggttcatgtcagtaatgctaaaacatgctagagtgtcttgcaccatgaaagcatttttaaatcacttgatcaaaagaaaaaaaaattctgcaacattttacagtagctagcaacgcatacattggtcctccaatggtttccattacaaaaggatctggtcaatgaagagggagaaagggttctgagcaatatccaaagtagtttattaagccatcttcatagttcacataaataaaaagaaaagagtgcttcctt

SEQ ID NO: 776 - DNA, 6656 bp, Oryza sativa
gatatgattgcattcgtccgtcgatcgtcctcgtgtgtgcgtgtggcgtgcgcgggttgggcacgaggtgggcgcgagcgcacgcaagcgcggcgtaaggcggcacagggttggcgcgaggcggcacgggctggctcgggcctagccgaggagaagaagaaggaaacagagaaaggaaggagaaagaaagaaatagaaaaggaaaaaaataaatagatggaaaaaagagaaaggtaaaaatagagaaatggaaaatatggagagaaattaaaatggttggggtttgaattgatgtggaattcagaagttttttatttttgggatataattgaatttggattcaaaggaattatttgacgggtgagatgcacttagcaacaaattgttgggtggtccaaacggaaaaaataactaagttactcggttaaaaagtgaagaaaaaagttatttgagaatgttcaaactgaaacttagcaaataaaatgtgaaccaaattataattcactcatctggacagaactctattacacttgaaaacaaaataaattcctatttggcagctttaaaaatggacgaacaacttcggaaacgggagttctagcaatcatgcaacaaccccctatatatccaatcctgcatatcatcatcgtctttgcgggaaatactagattcttccatggacgcttttgatttggagcagtataaacagccgtagaggtggcaatggcaatttggaggcatatcggctttttgcgttgagttgtcgtcttcccggacgatgggccgcgtcccagccggcatccgtgaattgattgattataacttataagcagcctcctaggtctgcgcaacggcggcgcagctctccaaccttccataaaacaacaatctaattaatgtgaaatattttctctgttacaaaataaatatagttttgcacggttcatattcaacgtttaaccattcgtattatttaaaaaaattttatgattagtgtttttattgttattagacgataaaacatgtatagtactttacgtgtgactaatttttaaatatatacttcacggagtatatataagcataaccctacgctatctactgaaccaatttacaaaaacagaatggagagagattagagaaccgtgtgaattagcacagataagacttcttatacaagagatgacatgcctaaatatatcacgctaccaacttcctccctctcgtttcagggagacgacgagagaagctgcggctaagctggtgccgccacctttcacatggaagccgccgctcccgagatagagaggtgcgacgccggcgacgtggagtcggaccacgacggcgccgccgccgccgccgagcgcgtgccgccgtggcgcgagcaggtgacggcgcggggcatggtggcggcgctgctcatcggattcgtctacaccgtcatcatcatgaagctggcgctcaccacggggatcatccccacgctcaacgtctccgccgcgctcctcgccttcctcgcgctccgcggctggacgcgcgcgcccgccctcctcctccccggcggcggcgccgcctcctcctcctcccggcgccgccccttcacccgccaggagaacaccgttgtccagacctgcgccgtcgcctgctacaccatgggattcggcggtgcgcgccccgctactacttcctgtttgatttctctccccaagtctttcttaatttgttcttgcgatggcgcctgtatataaaattgggggatatcgtgcgcgcaggtgggttcgggtcgtcgctgctggctctgaacaggaagacgtacgagttggccggggtgagcacgccgggcaactcgccggggagctacaaggagcccggggtcgggtggatgaccggattcctgtttgcgattagcttcgttgggctccttaacttgcttccactcagaaaggtgtgtactttgcccacaatttttgttccgttggtactgaatatgcaatggattaaattagacctgtccctgcaaattcaggactctctggagttcctgctattatgttcgttaattgttgtgatttgctatctttcagtgaactgtttttttctctcagttttgtttcggatttttggagaatatagctcagttgttgcatgtgaaatctgtgctatattctcagttttgtgctgatattaaaaattgtgaactcactcctattttaagatgatattttacataaacaatctgttgttacatttgtaaatttgtctgatcccagtatacggataggtcatgttttcaagaaagactaggaagtttaagttacccatcagtctaccactatctgttttactttgttaggttcttgatctgctttatcttgctaacctttaaggctttaactagaactacttgttcagactccagagtaatgcacatcgtgtgcatggcatggaaacccaactaacctgcaacagttcaacaccaattgggagttctacatagtacacatcctaatatttggtatgcggcattacatttccattatccttaaccaacaagttgactaaagtgctaaaacgaaatgaacttttttgagacaaataaaatgtcatagactaaatgagacaactgtacacacgaattccctctagatactcttcttcaagtctaaaaaatttgtcattacaatctgtagtttgaagacagaaaccagttttctttgcatttgtctgtcccacctaatgatgtgcatgacgttttcaggctttgatcatagattataagttaacctatccaagtgggactgcaactgctgttcttataaacggattccatacccctcaaggagaaaatagtgcaaagtatggtccaggtctcacttgtgctaaatacatcatcgcagttcgtgatatgaattattaattctacttttcatgccaggaagcaagtccgcggatttctgaattgctttgggatcagcctcttatggagcttcttccagtggttctacactggtggagagagttgtgggtttcttcaattccctacctttggtctaaaggcttggaaacaaacgtatgcattattggtcacccattgtttgtacccctactttatgcataattgcatattcgtcaggcagccagattctcctaactaccaattttttttgctgcaggttctattttgatttcagcctcacatatgttggtgcgggaatgatctgctcacaccttgtaaacctctccgcgctctttggcgcaatactttcttgggggataatgtggccactgatcagcatacaaaagggtaagtggtatcctggaaatgttcctgaaagcagcatgacaagcttgtttggttacaaggtcaggcatacaatttacctttttctcaaaatagtctgatgtgaatccataattttatatggtacagtatctctaattttctccttctcagtccttcatgtgtgtagctttgatcatgggggatggcctttaccacttcataaaagtaacaggtatcactgctaagagcctgcatgaacgatccaatcgtagacatgctaagaaaggtaaacgtgctctgcgaaattaactatttccacgttttcttccctcttatatcaccaaggtagctgaagctgagtgaattgcagcgacagatgaggatacatttgtaattgctgatatgcagcgtgacgagttcttcaacaaagactatattccaaactggctagcgtatgctggatatgccttactgagcattgttgcggtaattgcgatacccataatgttccaacaggtgaagtggtactatgttgttgtagcctttgtgcttgctcctgtgctgggattctccaatgcctatggaactgggctaactgacatgaacatgagctacaactatggcaagattgctctcttcatctttgcagcttggggagggagggacaacggtgtcattgctggtcttgttggttgtggaatagtgaagcagctagtacaagtctctgctgatttgatgcacgactttaagactggtcatctgacattaacatcaccaagatccatgcttgttgggcaggccattggtacagccatgggctgcataatcgctccactgactttcttgctcttctacaaagcatttgatattgggaaccctgatggatactggaaggctccatatgccctgatatttcgaaacatggccattcttggcgtcgagggcttttctgcactaccaaagcattgtcttgagctgtctgctggcttctttgcattttctgtgctcatcaaccttatgagggacttcttgccacgcaagtacagggattatgtgcccctgccgacggcaatggctgtgccattccttgttggtgcaaattttgctattgacatgtgtgtgggaagcctgatagtctttgcctggcacaagatcaacagcaaggagtctgcgttgctagtgccagcggttgcgtctggttttatttgtggagatggtatatggatgttcccttcttccctgctttcccttgctaaggttaagccaccaatctgcatgaagttcactcccggaagctagagaaacaggtgtttcctggatgctgagttcgacatggtatgataggtgagatgactaatatataatcattttggatactagtgttctgttaccgtattattccttttaatgaattgtgcttattggaggttatctgttcttttaggtaatggatagaccggcctctgtatctaggatgcacaaagcaaaccatcacttattacaatagttccacgctgttttggaaagataaaaatgcaacaagtttgtcaagtactccctccgtttcaaaatgtttgacatcgttgactttttagcacatgtttgaccgttcgtcttattcaaacaaatttgtgaaatatgtaaaactatgtgtacatgaaaatatatttaacaatgaatcaaatgatatgaaaagaataaataattacttaaatttttttaataagacgaatggtcaaacacgtacttaaaaagtcaacggtgtcaaacattttgaaacggatggagtattaaataggcaccattttggaggttatctgttggtgccttgaaaatcagtttttctcagtatttccagagggaagtggatcttaacttcttcagactactgttaccggttgtgtattgtgttaagtacataatagagaacttgtagttctgcatcattttgaaggataaatatgaatagagtactattgcccaacctcctgtatttagttattttagtttgtttttttagatagttgctacaccaaagaattacagtaattaatagtgctatgaccttgcaagtagcagcgcctcatcacatattgcaatttttggagagtgtactcattcagaacctttccgggttctgagtggaacttctggcgaaatttctgtgttcctctcctgccgcatcccaggcaggtgaagagctctcagctttgcctagggaactctatggaaaataataatggatcttattttattttttggataaaggggcgagggagacctcagcttgttttgaaagctgatatggttcttacagaagtaaataaaaacagaaaaagttgatgatgaggacatcagcttacaatcagaacatcaaaagaaacaactttccacctgtgtggtaacgttacaacgcttcaacctcttcaaaaatttcctttgactatatatctcttatccgattcctatgttttttctatggtccaattaaacgattatttatatttgttgcaataatctgttttacacatgtatcttgtatttaggttagaatcttgtgttttttttctttgtttttctatttctacaactacgaaggtagcccgcacattcgtgtgggcatgcgtcatacacaaattaagtttgagacacttataagaacgaaacattaaccggagaacatcagctatgatttctccgtaaattattttggcggcattaattgcttttataattttctaacgtaagtttattagaggacaaattgggtgggacatgaagctccactaaatgtatgggtttataaagcctaatatgattgatatagtttgagaggcggtccatctatgaacatttcagtaaagtgggtcggaggtaccacacaatctaacgtgaatacgataaggacgaaatataattgcacaataatatttttgaaatgtaatgtacgatgaatacacacatgttttttctaatatatgatagatctaacggttagaaataatggttccaccagtttaaaacgcatatgagtattctagaaatatagtttaaaaactatggttattttaatatccaacattattgtgaagtaaactaactcaactggttaggtttcttatggtagaacttgcccactcgggttcaagtcctagacttaacaaattctttcagtggtaagcgacatatctgtcgacagcgtggcactcgtggtgacttcgttaatctcaaaatatgtcagcctagtctgttggaggtactcatagggatagggtgtgtgcgcacgtttataggggtgagtatgtgcgcgttgtgagcgtatgcgtttgtactttgtttctcaaaacaatatccaactttattgatttttttc

SEQ ID NO: 777 - DNA, 3481 bp, Oryza sativa
tgaagtggtttcggttggctgtttgtgagctcatcattggacagtttgtacaagcctgaaaggatcataaatgcagttttgtgcttgaaccagaactggttcttcttgctgcaagtggcaaggagtcactacattatggagtattcgattggatttttgctgaaggttgccattccagtgatggaaaggccttattgatgatggatattgcaccctgattgattttactcaattgttttctgttggtatagaaaccagttaaatctaaaaatattctcacctaataatggctctgtagtctgtccaagtatatataaactagtgcctactaggactatagacgatggatccacttgtcttgaacttgttagtcagctttatgcttgcatcagtatgcagtgtgctattgtttgacagcaacataattaataatggatcataccatattgacaaacaatcatttttggccggtatgtagaattgtagggaagatggtcttacaacttattaatagaagctcacctctcgttcattgggggcatggaagtatgatctcttcaatttcttcaaaccttgttttagctaatcggatcaaactactgtaaaaggtgaaaaagatcatggaaatttaaatctaaccactcaccattgcctacccacatgaatccaattcacttaccgttgcaatcccaaaccttgcaagattttagcttctaaaccggggcccgggataaatcgatcacgtttcacaaacatctagcacaatcataagatttttttttttaaaaagcatatgcgatctaaagaagacaaaataagcaaaggaaaatgtcgtcctcttcaacaccagccaggggtgcgcagaggcatgaaacaagcctcattgggtatgcacgcatgaagaaggttgccaattttccatgcatgcataatgcgttccacattcttcgactacgcttttagccaatctttgaggcaattctcctgctatatattgccccattctttcccatttcaaagctcatcaagcagctcaagcattccacaagcttgccgttttccactgacagctcaagtgctcgtgcaacattagctgatcagctcgtgttcccaaccgcgacaaagcttcacagatggaggctcagaaccaagaggtcgctgccctggtcgagaagatcgccggcctccacgccgccatctccaagctgccgtcgctgagcccatccgccgaggtggacgcgctcttcaccgacctcgtcacggcgtgcgtcccggcgagccccgtcgacgtggccaagctcggcccggaggcgcaggcgatgcgggaggagctcatccgcctctgctccgccgccgagggccacctcgaggcgcactacgccgacatgctcgccgccttcgacaacccgctcgaccacctcgcccgcttcccgtactacggcaactacgtcaacctgagcaagctggagtacgacctcctcgtccgctacgtccccggcattgcccccacccgcgtcgccttcgtcgggtcgggcccgctgccgttcagctccctcgtgctcgccgcgcaccacctgccggacgcggtgttcgacaactacgaccggtgcggcgcggccaacgagcgggcgaggaggctgttccgcggcgccgacgagggcctcggcgcgcgcatggcgttccacaccgccgacgtggcgaccctgacgggggagctcggcgcgtacgacgtcgtgttcctggcggcgctcgtgggcatggcggccgaggagaaggccggggtgatcgcgcacctgggcgcgcacatggcggacggcgcggcgctcgtcgtgcggagcgcgcacggggcgcgcgggttcctgtacccgatcgtcgatctcgaggacatccggcggggcgggttcgacgtgctggccgtgtaccaccccgacgacgaggtgatcaactccgtcatcgtcgctcgcaaggccgacccgcgtcgcggcggcgggctcgccggcgcacgcggcgcggttccagtggtgagcccgccgtgcaagtgctgcaagatggaggcggccgccggcgcgttccagaaggcggaagagttcgccgccaagaggctatccgtctgagtgcgtgcatagtaatcctggctgtgtctcgctgtccgtgacatcggccggctgaaacattattggtatcggtttgtgtttgtgcttctgtggggttcttgttcttgttgtgtggatgatgctaggcgcctgggcattgatccgtgccaatgcattccgtgtttcggtgcaactctaggggacaacgacgagtaaggtgctgagaaagcaagaggtgtttgtcaccgtctgaaataataatgtaaaagggttatctacgtgaacttcgatcacgacagtcttgagtaggtacccgtgtggtaccacttcaagacccataatttttgtaaataaattttacaaaactatcaaactattcaaagctagagatttaaggcggtacatcatgaaactatttaacatcaaatttatcacgaagctacatatttaaaacagagcatcataaaaaatagtataaaaagcttttacaaaatatattttttagattttaaattctttgcactaatgctatattggcattaatttgtattttttctataactttgttactaaatttttgatataccatcttaaatatttgtagtaaaagtatcaatagttttgtgaaatttactctaattaaaactacccgaatttcacgcacagtgaagatagactgttacccattgaaaaaaataaattggattttctatatataatatggaccctcgttagttaatggtatagatattcctctttttgggagagctccctgcctcctttgatcggaggaaaaacaaagggaataaaaaattagaggatttgtatttctatgaattaagttactatagtgtcctttggatcagaaaaattgctcattgggaaaacaacggaaaaccaaagaacatttcctaagctactgattccacaggacaataacaatccactccgagctctcctttcggtttcctttgcccgaaagcttacaaagaattctatgtttttcctatgctctatccaaacacatacttctattcgataaaatttctctgtattttaatcctctgatttacacaccaatctctatcatattcctagttttttttaatcttgtgctctaaaggagctcaaagatataatccccttttgtcattaatatgtgggaactttttgcatacttctgacatataaatatttttagagaatttactatacaacattgcatgcactggttagctaaataacgtgtcaccaaggcaatctgcagcgccgcgtcgtctcagcgccactcgacatcgttggcgtcagacttttaaataaaaagaaaatccaccttactcccccgaactaattcatgggattacttaacccttaaactattttttttc

SEQ ID NO: 778 - DNA, 6017 bp, Oryza sativa
gcctagctaagcttgagccaagattttaccctcaaaagctcaccttaaattctcccccaccccaaagccaaaagatttaaataaataattgtgaatttttaggataaaaacttgcctaataatagaatattactaatactttaagagaactactatgcgagacccatgtttgattaaaattttacctataaaatttttgtgtctggcctcaaggttagacttagtattggcctttttaagattagcctctttctatgtccaacgcaatattatatttggtccatctattttattgactagctaatgaaggttgtatagattgaatatcacatattagagcgtgtggtgaagattgtatttttagttctttccatatttgatacgatatccaactatcttctcttagaagaacgacccatgatattaaataaattattctatcttggatatgttagatatacatatcctaattgaacctttattgcctgagttagtagtcgactactgtgttttttttttcatgtgtagataccgtagaacatcctaaccttcaaatagtcaaagatagagacaattagtgtcaacatcaggatgtgaattctatgattagtgggcccatttataggtaatgacatgtatgttttaaagtagttcaattagaaataaattaaaagaactggtaaaataaattaagatgatgaatgggtgacaatcttttttttcttcttctaaatgttacagtacctcctaaggaaaatatacaatagatgttatcctacatataagaatagcagtgtatagttggtagtgaggggggagtggtccaaagaaagtgtggttaggaggaaaacaagagagagatgatgagtgtaattagtgaggagaagtagtagtaagtaacaaactgtgtgttggtcctgatagatggagggtcagtcgctcacagttagagagagaggacaggaatagatggatggatggatggataggtactccagatagatgagatgagatagagaagagagatagagagagaggcaggctggtagaacgggtcacctcaccaccttcgcctccgcctcctccttcgcctccgtctccacctctcctctcctcttcctcttcttcctcctcctggggcctagccgcctaggggggttgtggcctgcgactgcgacttcttcctctgccttctgctctctgcctctgagtatatggaatatggtgtgtgcgtgaagagaaattaagtgagggaggggaaagcgagcgaacagggcaacaatggggcaaatggacggcggcgacggcggcggcggcggccacccctaccactaccaggctctcctggccgccgtccaccagcagaccgtcccctttcccaatcccttccccgccccctcctccggtactctctctctctctctctacaccttcttctttcttacctcaaggaatgttagggcagcaggtaggcaggcagaccaccaaaattcagatctttttctttatctattactactatactatactattattaaaaaggaacaagagaatcttgaggtccttgtttaccatttattaatctagagatcccctcccctcccctcccctcccctccgcttctgcttgattgatttcattttgggtctactcctactatgtatgtattgtatttagggtgatcaatcattcctcactctgtctattcaattcattcacttcacttaattggcccatctatgtatgtatgtaaatgtaattgaccatgtgcttggattgcaggagccgagcccccccacccgcacaaccacaaccacaaccacaatcacaaccacaatattcacaattctcacaatcacaaccacaatcacaatgctgctcctcacccttgtcacactcccactcccactcccactcccagaggtttcgccgactggagcgcctccaccagcgccttcacctcccttgccgcgcactcttctactgcccccagcaatgccgttcactacagcttctccccctgctatgccttctggacacattacatgctcaacaagaacgcctaccccacctccttccctgcgccacacgacgaccacctgcgccttgccaacaacaatcatcctagagacgcaccaggtacgttaaaagctatctcctttccaactaaaccagcatgtactgcattgcctttttttccttttccttttaaagcaataaccaaaattaatcttccgttgcgttgttcagagctacagatgttgcttgtaacaactaggaatttttaccgacctagctcattttaattattcatgtgcctctgatgttgaacaagtaggtccatgaggcatttacattattcctctccatgcttccatcaatatgggtagtacatctaagctactgtattccactttggcattagctaatagccaggttttctcagtcatgtacatatggggcagctatttgcgtcccgccaaattctttcacccagccatcctcacttttttccacatatcctgttttaattacaggtcctgcatccagctacggggtcgagtcttttacttcaccgtccatggcaccgaatatttgcacccacatgcctcccatagaaggacccatatctgccaaggaagataagaaaccagaggtatatacatcagaacattcaagatttggaaaacccttccagttttcatcatcctccataacacataatctaactaccgtaatggatgctaaccagattttgcctagagtggttaagagcagtgatgaattggaaaccagaaacagcaatgttgaatttcactctgagacagttggtactctccctgagtcgaagcaaggccatgacagtcgtgctactgtgagtaacacactacacttaacatgctgtctgtatctgatttactacacaaatttctatcttgcatttaatctacattaggcaagtacatagcataagtaatggagcaagtatctatcaattactcaatgccgatatagtcatttgagcagaagggcaaatgaagcagcaattccttactagtttagtaattcaagtagcttgtaaagatgattagccaaaacactgatgcagtacacaggcacatacttctgtcataattagcaacttcatttcctttgtgttcatgggagtgtgcttttatgccagaaactactcaactcgggagaataccaagtcattctgcgcaaggagctgacaaagagtgatgttggaaatgttggaagaattgtgctacccaaggtgtgttccgtatttctgtctcttggaagttctctagtatcattctgtgagaactttcatgtggtctaaactatgcttcataatgtaactgtctgactttatttcagaaggatgcagaggctagtcttccacctttgttgcaaagggatcctttgatactgcacatggacgacatggtgctcccagtgacatggaagtttaagtacaggtgcctttcctgccatcttatgacatctctcacatgcgatttctgaaagacaacaaagaaaaaatggttctgaattgcaatgacttaacaagatgcctagattaagaaaaagtgggaggttgaaggcactgtatgcattaagttccacagcatgtttaggaatctgaaatttgtaaagcagttcataggttcatacatcttgtggcagctgcctgattgctaattctggttcggttacatgatcagttttcacaggatggagaaaccgatacattgctgcctaacctagatatactctagcacttgctactactaattcacagagtcaacgatgctatttcaggtactggccaaataacaaaagcagaatgtacattctggattctgcaggtatgattcaacatggaaagtattgagtatttcctgcggaagtggacatggtagattgatatttcgtattcatattggcaggtgaatttctgaagacacatggtcttcaggctggggatgtcatcattatctacaaaaacttggctcctggcaaatttgtatgcaacccttttctttcctgtttcttcctttttgtatattgcatatctgacgtcagcatttatggcttgcaaatctcaatcatcgcttgacataactgataaaaatgctcagtacaaaaagttgagaaaccttactaaatactacatccgttttttaatatatgacgcaattgactttttgacaaacgtttgatcatttgtcttattcaaattttttgtgcaaatatatatatatatattaagtgatgcttaaagaacatttcacaataaattaagtcacaataaaatatatgataattacatatttttttggaataaaatgaatagtcaaacatatctcaaaaagtcaacggtgtcatatattaaaaaacagagggagtaaaccaaaatgacaaacatatagatcaccactcatgaatattctgtgggatgcactcaaagttgccatctccgttcattttccctgaaaagtatgttaataacgattcttcgcatatcttattggacccttgtgttttttttacaaagattatccgaggagagaaggccattcatcagcagacaacaaatccctagatgcatttggggttaattgcaacagtgttagttgatgcatttgaagggaaggacgtggacttaccataagttggcaatccaggagaagttgaaagtgtcatcgatttttatatcactggtggccaccatcacatggacaaagattaaagcgcatgcagcttggacctgtttaactctgaatgaatgaggacgaaaaaaagacaagattggtagagtattggaagtgttggcaatgggcttctacagcttatcttgggttgagaaaagcacttgtcagtttatttaattcagttatgttggggagcttgacttgtagttttcagaacaatatatttgcagcttctgtaaatatttttggatctataagataaaagagagtggtgtgtgattttgcttttgatgtcatccatctatttctcatactaatgccaggaatgtctgttcattgtcagcagtaccctgtatccacaacattcaccgtcctggttgtctgtggtgcctttctgccagtagaaacatcagccaacaaaaaaaagtagagaactggaggtgcggggaatcgaaccccgtgcctctcgcatgcgaagcgagccatatgagctacacccccgatagttcaagtaaacacaactatgtcatatataccccatgatgacagcattatagccataatatataatatgatcagttagttgtatgtttttcccttggatgaagaatcagttgtaccgagagaacagacgttcttttacattaacagcggccttagaataccaaccaccaccacacctgacccaatatttacagacattccctttctattgaataaagtgcagcggcagcatgtactccactttcttgcagcaaccaagaaagtacccgcatacccgcctgactgatggcatgttcttccccaataatcaaggatagacacacggcagctaaaacaattcaaaggaaaaagaaaaagaaaatcctcaaaaaacattacttatcccgtggcaccttggttagtctaagctctagcatcctttggttgtcttcatgccattagtacaaatcaggcaaaggctcctctctgtcaacttccccgataggatgctatgcaatacatctctccccctttccaaacaggatcttttacatcagtcccgcgtccatatgggagtttcatggtataccataggcaccaacctacaggataaaacaacaataacagattaatcataacagttccaaacgcaaaaacaactcaaactcaaagctgaaccaaataatgaaacattactggtgataagcagagtccttatagaaaaacaaaacccaaaacaaggagcaacacagttaaaaagaaaggatctaactaaaagaaaaaaaacggctgaagcttcatttaccctttttt

SEQ ID NO: 779 - DNA, 6119 bp, Oryza sativa
ccttaaataggggttggtcttgccccctacaggcccttcttcatgcccaactcgggatagaaaccaaaggaaatacgaaacatgccttcccgagcaagaaaacccgacacccgacgaaaacagactcggacttggaccctgccggtctgatcgcccacatacctgcggtcagaccggccctactagccggtcagaccgcccatatacctgcagtctgatcggccctgtgaaggaaacccgatactttccaaactttggcaattttcccctatttcgtccataggtgccaaatttaggtgtaataagcagaaactactcctaactgaatgtataaattcttgaccaagattgaccctcgaattaactatggaaaatacaagaaaaatctttcataagaccaggctgtcagcggtgacaggagtacacaaaccagagagctaagacatctggtcggcccaaatagtataaagcccaactataagaaaccactcaaatgcggcccaatagtaaccgaagtagggaccaccaccacctcccctccacacctccacgcaaaccacagggccccacacttcagcctctcacaagtcactaaaccacccgtagaaacgaacagatgacaagaaatcgccgggcaactaccgagtcgggggaaacttaccaaaacaacccaaaaaccttccaaaaccttttctttttccacttattttaatcaaaccaacgcaggaaagtcagcaccggggaggcgactgcaaaaaagccaaaaccgaggtcgcgtgcatgcgaagcttcctcgaagccgcacgacgcggcgaggggaggggggaggggcctgaaagcaaaagagccgatctcctgggcccactcgtcagcctctcggccgggcccggaagtaaaaagagccgattccgtggggcccactcgtcagcctctcggcccagcaccagcgcacgccaccgcgtctggggggggtataaaagagcccccatcacagcgacgcgagcggttgcttcctccgaaaatcctcatcctctccattgaccagacggcggcgcaggcgcaggcgctcacctccctcctcctccgcggcatccccaatcgaccagctggctcccctgcctcctccgcgtaagttcaccccgatctctctctcgaatcccttgctccgatctccaatccgcgctggttctgtgcgggtttttggattagggcgcggttagcgtcgggggatgtcttggggttggggggtagggttggtggctatttgggggtttggttcgacgattcggggatgggggttgatggatttgtgtggatcggattggtctcgtcgataggttcggggtcgcggatcagggtggtggatgtgatgcaggttttgtgtgagatcgatttgatcgtcgattttggggcctaatttaggattggattgcttggagagcattggtttgtgcagcgttgacttaggtacggtttttttggttaggttgattgggggttccgtttgatcgttgacctgtggtttaggacagatctggaattctccaggttcaattgaagggaagattatctcttttggggggatttcaccgggaaatatcaatcaaccaaaaactagttgtgatttccttgttgtaacatacgtattcgatattcagttttccttctatttcggtttcctccgaaaattaaagtagtagctgcctattttctttgtttggacatgctcatgagggtttatcaagggtttagaatgtcatattttaggaaaacctgtaccttctgctttatatgaccattcatgtttcttatgtctgtcttattttacttgcaggattttgatcctaatcacccatgtctgctgaagtcagcgaggaatatccttatttcctctcctgctacttctggttcatatattgcataaaattccgagatttcacttgatacaagtggatcacctggagttttgtgctaatacttcctatcatgtgaatcagttgtagttagcataattggcaagactcaagttttctctcatctgggttcagaaacatttgtcggttgagtgctcgatctaaactctgcttgagtcttgccgaagattgtttctcaacaatcacgtcttctgttctctctgaggttggaccaatctcccttttggtctgatcaacctcctgatctcccttaagtgaaccgtcctgctgtgttcacgcaatacaatcttctgaagtcctctcttgttccttctgtgctcaaacatcaaaagcagctctctcctaagttctcttgattgtttgtgctcctaaattctgttgtttgagcactcaaacatttcccttactggtcaatcttagatcacttgttgattattggtattggcattatttggtgaagcatttctgcttgtaccttaaacaaaggtctctgttgtcttattggtgctgaaggcaagatatacactgcagtgatggctcaaacttgcttgccacctggctttcgttttcatccaacagatgttgaacttgtttcatactatttgaaaaggaagattatgggaaagaagcctcttattcaagctatatcagatgttgaactgtataaatttgctccctgggatcttcctggtaattcctaattctcatgttatgatgtttttagaaactttaaataaatgataaaatagtggtcacgaagacaatttctcaagaaaaacatgtcatttattctcaattttatgcacaattttgctctaatttgtatgcatcaatcttctgcagctcaatcctgtctccagagcagagatcttgaatggttcttcttttgcccacgagacaagaaatatcctaatgggtctaggacaaatcgttccacaccaaatggttactggaaaacaagtgggaaagatagaacgattgagcttaactctcgcattgttgggtcaaagaaaacactgatttttcatgaaggcaaagcacctaaaggcaacaggactgattgggtgatgtacgaatacaaaatggaagacaatcaattggtctctgctggtttctcaaaggtaatgctatttagtatgcgtattgcttgtcgagtaagctctcacaactacacttagctttatgtgatcaagatttagtaattccttattttatgttcatcgttctgttattatctcctttttattatctttggaagtaaaattgtattctaaaccattagtaacagaagtggaatatggctgggctaataatgctctttatgtgcggtagttatcattgaagaaattttagaactccagaaacagataaaaaacaatagaatattgatccttgtgctgatttataggggctaaagtgcaaattgtgctaggcaccctttgttttgtttttatttttctcactcttatgatagccaatattttgcttttttgaaaagcagttatcaacgatgaagtacttttttggattttgatttagttaaaacaaagctattattggttttataactcttatgtatcctatttgggatattgtactcaatagttcttttaattaaacattcaggatgattttgtcctctgcaaaattttcaagaaaagtggccttggtccaaggattggggagcaatatggggctccatttaatgaagaagaatgggagcatgcagatgctgaaatgtttcccttgctgccaaatgttgaaacttctgtgtttccattgctgccctcttcagaggtagtaaattctactgatgatacacgtgttcagccttctgttgctgccagagctattgaggaactacctgtgcagcatttacctcatgtatgtgctgggaatggatcaacatatcaaaatattactgttactggtgaaagtgctctcatggaactgccttcccagcactctgttgaatctattggtgatgaggtagtttctgtggacaactgttctaatgtggtcaataatgcagacagtcctgtaattgaggggcttgtattggaggaactttctaggtttttaactgattctcctcatcatggcaaccctgttggggaggtagatagagcttgttcattatcagatctccctgtattccttttatgcttgggcatataaaaatgtctgatttttctctgggcttattattttatctatttattttgcagcactctggtctcccaccaatgtctgaggctgaagctcatgcttttgaggttagcacaaatgatctgtacaatgaaattgcagggcttgctgaattgggtgtgccaaatggtgatggattttctccgtccaatgctggtgttactgaacaacagcccacatactttggagttcctaacagtgaaaattatgtaaatatggatgatatctttgctccagacacaagattatcctatgcatatcctttgccaaacaaccaattttggcattatcccatggatcagttcacatacagtactactctatctgctgcctttccatctggtgactcgcgtccaactatgcgcattgttgatgatttacctgctgctgctaataacggtggctttgcttcaaaacccagcatgcagttcccactgtcataactaagtccagaaccgttctagaggtacagtttcgtttttaagttgtttgttttccaggtattaattatttcgggctaatttagttgctgctattaaatcttcaggactctgatactgatgacctagtgggattccatatgctggcagtactgcgcaacagatgtgtcttcatggccacctgctgccgctccgagctaagccaaacctcgctgaatctttctcgtggactgttgctggatttaccagtgctcgaactggtggtcactgcaagcattgtgaggccaacaatgtacattgttttgaaggtttggcctagttctcgatggcgatgctctatgatccgaacttgtctagcctggcgcgctactgaggatcagatattcgctttgtgttaccttatttacttgctgctgaataaagtttgtttatcaaactagtgtatattgtgttatgactgcacttaaaccttatgtaagtttgcatggtttggcctactatttacttgctattaatcttctcctaagttcgttgttttggcatggattcctggtactatataatgttttgcacatgcctacagtacttctatgggccaaacttacgtgcacatttagactgaaacggtgcacgtatttgggctgaaattgtacaagcatatgggcggaaattgtgctagtgtacggcctgaaattgtgcgcccgtttgagctgaatcaacgctgatatttgtgccgaattatataacacggaccggcacatttgggtcgaaacaccgcgcaagttaggtctgaaattgcacgtacaatgggcaccaagaacagagcgatgacgtgcagcccagaggcagaaaatatgcaaactaatctggcgctctcgagatcgcaatgcaaactacgctacatgtttggaaattgcttactcgaaaagtgtaacataattaacatctttataacaagaaaaacgacgagaacatctctccaagtgatcaacctaagaactccgatgataccctgcgtaattgtaacccccattgggcagcatctgcatctgcatctgctgctgcggtggccgctgctgctcgagcatggcgagcgcgccctgcccactcatgccgttcttgccgtactgctgccacaccatctgctcctccaccagctgatgctgcttcgtctccatgtccgacatctgcacgtacgccggcggcgccaccgccatggacgccgcgaaggggtcgccgctggcgccgctggtcccgggtggcgcgggcagcgcgagcatcggcgcccccggcggccgcatcgccacgctgctcgcgctgccggagaacgcctgcgcgttcgcggccgtcgacgccgccgccgcttggctgtacatcccgtcgagcaccagcatgctgaggccgccgccgagctcggcgcgctggtgggcgagcgcgctcgcggactggaccagcgccgtctcccagtccgtcgacgaggggtcgaacgcgtcgggcgccggcgccgacccggccgggttaccgtcgaacagggcga

SEQ ID NO: 780 - DNA, 13213 bp, Oryza sativa
gtcctagcgaggcggtgcgcgtgcacaacgtacggtgtcagatggtttgtcaaaattggttccttacccttacgtagatgtggtctcctttttgcagttttgttttgctgcagtaaattctgttttgttttttgtaaacacttcgaatatccggtgcgtgaaatggcgtggagtccagataagttatacatgacttaaccggtttggttacacgaagtggagatcgggcatgcgccttgatcaagcgtcctaacatgaatgggtacgataagcaattttttggtggtggaggcgttggtggggaggagacactagacaccggatgctcggcatcggtggcggatgcgacggctgattgaggggaagtgctaagtttagtcaactttaaaggatgattttacccctccgtaactttttttaacaattatgcccctaaatatttctactacagttaagtgggatggtggtagaaaaaaaaatctgaacgcttcagataatgattcagattgttttcaactattatcaatatagggcaccgagatcatattaaatctttagtttttgtgacccactaccaacagtgaatcgacgattctcagcttcgacgattctcagcccagaaagcctgctacagtactacaggacctcacccttcatgcaccgtccgggacgatgtccacgggttcatcgatccatccgtctacgcctcatagccgcatcaccccgatcccctccgtcatcgctcctaaccaatcagcgcacccatcgtcccaaaatccccaaatcttcatcgcctcctcgtgaggttcgtcggcgccgacaccgccttcttgcggagcctgcggccagcgtcgccgctttcttgtcgagtttctagagagaccgaagacatcgacggcatttgtaaatttttggcgtttacaatttgtcctcaactggttgtcgcgatccctatctatattctatccacagcagagcaagaagctgatccggactgcctgccgtacgtcgcccggccggctgtcgcggccttgtccagctgtgagagacgcacaccgcgcacccaccggcgcccccaatggaccccgcggatccggtcgctgtcagcctcctccgcaatccaaatgtccaattgacgcaccacctcgatccgtaccgtcgattgcaccagtaatccgcaattccgcatcatgccgtacaaggggagctgtacgtcggaagcgagaggccatcggcgggcattaaacaatgggcatttgtttgggttggagggggttttgagagagggaatgggttaggtgagtgctgttcctgcccccaagccgacgactttcgtcctcgatgcttgcgtcgcatctcgaatacaccgagtgtacgttgggagaagtacagatatgcagagggatcgcggagttgacccgtattgcatgcaggcagctgctgcttttcttgcggcaaccggagctggtgctggcctcgccaggttcaggttaatggtcaaccaccaccaccactagttgcgctactgagacagagcaatggaggagggggcgaagatcgggagggagcacgagcagcagcagcagcagcacgggagggtgaacggtagcgggagggtcgcggccgtcggtggcggcagcggcggtggcggggacgagattgagattgaggtcgccgcagccgcaggggcttcgccgtcgcggcaacacggcggtctgcacggcgatgtccaggttagtttgttcttcttcctttcttcctcctctgctaggctgcctgctgtcaatttcttcttctctcctgctgtccgcacaagtaggaagcaaaccatgtgtagcacgattgcctcagccaattcagacatctgaggaatatccgtttgattgatttctgaaatgaatatgtacggttgatgatctctatgtactctgctttgtaaaattagcacagacttttcctcaaacggggatagaaacaggcactaatcaaaatttctgataacaatgaggacttttggctttgctagaatattttgtataggaaatctgttggctcgaccgtagatcgtatcatctcttcgtctggttacaaaataatagaccctttttgtggtatattacttagttttgccatggtttgattattcttcgagtagttggcaaggatgttttcttgcaataatgattatcaaccgacatcggttaggcatgtttctcttgggcttcaatttaggagtaagccgtattccccaaaaaaaaatttaggagtaagccaattcaactcactcgcgtattgccgagttgagattttagtgtcattcctttcacgttggtgtagctgactttgtattatgacttattctacaatatgctatcaacaaatgttgtgttctacaaaataccatcgacgaacatgaatttcacaatataatatcagacaatggcttttctttccttttataccgtcatttgtcagtgacatgttcttttctctatttagtgccgcaaaagtacagttcacccctactataacatgggttcaacaaaaattgcgagggtgtctcggtcttgcaagtggtagaaaacaagagtaatctttggtgttccgcaggagctttggcacttcaaaagctcctcagtgggatggctaacctaggcagttagcgctcctcggtgtggtcttgggtgcgtgggtctcggtgggagggctcgggtcctcctactttgtaaatattttctactttgttttttcttccccttaatgaaatgaaacacaattctcctacgttttcgagaaaaaagaaagaaaagaaaaaaaccattttattatcatgatctttcatagagttaaacaattatcgatcgtaaacttcaaaaccatgaagtatatacccttgaacttgtatttcattcagttttcaactttggcccaaatttagagttgctttgattaacatggctctaatgtggcaatctagctcaaggatcaaacaattcttgaatttttaaaattagatgtcttccaaattttagaaaaatatttcacttgtagttctctgatatatgcattacctacataaaagattaactggttagggaaaaactaatgtttaaaacagtgtaaaaccatctattacaagacaattgaactttattccaccagggaaaaaatatttaagttgtaaatactgcaacatgcaactttttttttcagaactttttgagtccatttagtaatttatatctgtgagagcaggcacccacttggaagagatttcttgcacatgttggtcctggatttgttatctccatcgcataccttgatcctagtaactgtaagtcccctttgtccttcaatcttccttggactagaactatgcctgtctctgctcaccagtttgtgtccatccatccatgcatggtgagaaaaagacatttttaagtcataaatggctttggtaaattcaacaataggatcaaggaacatggatggataccactagaattcctaggcaggacatgctcatataccaccgttttctttttctagtactaatatattgaactacttcactttgaaaattggaacagtgcagactgatttggtagctggatccagccacagatattcggtataaagctctcaaaatttctgtggaatattatgttatacatttttgtcaattgattgtagatttgccatctcacttctccttcattcatttttaaaattttcagttgctatgggtactcctatttgggttcatatttgtgttgactgtacaatcattggcagcaaatttgggtatcattacaggtgaaactaactacccatattatcaagctggtgacaaaaatacatgttctatgaaacttaccatataaatatattgtaggaaggcacctcgctgagttgtgcatgggtgaatatccaaagtatgtcaagtactgcctatggttactagcagagcttggtgttattgctgccactataccaggaggtatgtatcagtatttgttgtttgtctttgctttctataaaagttgaaatactatttttacttgttacttggaaaaatagtatcctcttttacagcatatttgttgtccatgtataaaccatgggggtaatccataaattaggttaatattttgaatgaacttccttgtgcagagtttgttttattgaattataaatttaatagagctattcaataactacggctggtggttgagcaataggttgtaagcgaactgaaattttgtgtttcatcaacatctgtagcatgttgctttatgtttggtttattcttcttggcatggaaaacttgtaaataagtgatcatggctttgtccatctctgggtgcagtggccgggataataaaatattccattatctaaaatattgatgattattgcatataactctaattatattttgaagatagaaacaccaatagtgtggtttatgagaatgttactctcacggtatagggtttccatgtgtttatcttgctttatttcttaatcaaatactcccactggtcacataaatcaatttggacatgtgctaagtcaaactttcaaaactttaaattgtcatatttctttctaaatagatttgttgtggaaagttccttatagtattatattgctggtttataataaatatattgtattagaaattaccatctaatgttgcactatggagaccatgtcaatgtccaagataacatgtttatgtaactggtgggagttattttcttgtgtgccagttaacttatctatcttgatcacattttttataatctatttcttgacataggcttacaagatctgcactatacactacagttctcctttataaatcttacagaactttacagttttatcttctgtatttaaattcttcaaggttcatggtgctttctgtggtctttgtgcagttttaggaactgctttagcctacaacatgctactccacatccctttctgggccggtgtcctagcatgtggggcatgcactttcctaattctcgggttacaaggatatggggtaagaatttttctctgcttataaaataaaaaagagtaaattacactagcggtccttaaacttgtaacgaggtttcacttaggtccacgaacttgcaaaacgagcatcgagatctctaaacttggtttaatgtatcatcctagtccaaagcatcgtttgactgtggtcttgcctacgtggcatgccatgtggacgatgacatggattttttaaaaaaaatttctcccttctgccactgacaggtactggcagggcctctcttaccttacttttccctcactttcgccggcgaccgaagcggcgacgggcggggtggccgacgagaaaggagcagcgcgcgggagccggccggcgggaggagaggagcggcgcgtgtgcgcgggcgccggccgacgggaggagaggagcggtgtgcgtacacgggcggcggccggagaggataggagcagcacgggcacgcggggggaggtgtcgccgaccacgcccggggaggggtcgccgactgcggccgtgcgtgccaggggaggtgttggccatggagcgcgcgagctcggtggcggagatgaagccattgccgccgccggcctacccgccccctagctaaccttgccggccggctgccccgcttcgacccgcctgtcacccgcttcggtcgccggccgcccgtcccactcagtgttgtggatgacggaatacggatgtcggacggagagggtaccgctaaacgattaatcggagtacggatgagtaatcggaatttgacggaaatttaatgttttggacaaatatatgtacataactcataaatcataatagcttattatttttgacagataaatgcatataactacatatatacctactattcttaaataaaaataaggataacatgacattaactcgacataaaaatatggtagattggatttgaaagaggtttagatgaaaagaactaaccatagacttgcaggttgtagcggtaggaatgagctgcgaggattttgggattgcaaacgacgttctgttagctatatagtgctaggttacataactaatgggccagtatagttatcgtggcctggctgggcttgccttgtcacgtgattaggcccgtttattcggccgattagtcggatacggccgattagtcgctaatgatggtgattatacatcctgaaatgactaatgtacaccgttttgctaaaacgtgacggagaggtcagcgccaccattttgacgtccgaatatacagccgtaccaaccgttatccacaacactggtctcacttaattggccgaagagagaggatagagaggaggggagagtagtgaggccctgacaggctgtcagcggcagaagggagaaaaaaagaaggaagaagggagaaaaaataaaaaaaaatacatgtcatcgtccacgtggcatgccacgtaggcaagaccacggtcaaacgaggctttagaccgggatgatacattaaactaagtttagagatctcgatgctcgttttgcaagttcgtgaacctaagtgaaacctcgttacaagtttaaggaccgctagtgtaatttactcaataaaaaaacacaattaaggagctcactaaatatgatattttcaggaaaaaagtaaaggaaaattttgtcaacggtgaatgtccacttttcatatttgtcactaattcttgtgacttcttgttgattctactcttccatcaagccacatttccccacattcatcagcctgcactatcactgccctccgtgaatcttctgcttcctccctctccacctgcattagccaggaccttttccttgaaggatggagaaaatggaggataacgccattgtgctgtgaagcatccaaatatggaggaacttgtcagcgttgactggtggtggaggtggaggtagagaaagctgatgtgagcgtagagaatgtgaaagaagacgagggagaaaatacactgcagaagacagtggcaaaatagtcagttgacagacaatggtttttgactgaatcagccagaacctccatggcataagcaaaatgtggcttgatagaagtggcataaacctgatctcacaaaaataaatggtatgtgtgagaagtggacattcactaatggaatatgcaaaattgtacttaaaataatttccgctaaaaaatatatacaaaatattcccattcattctactgtccgaaataactatatactatctgagataaataatactggcattcatttcagatagttgaatgaatgggaatttcgatgagagagagatcacacattttttttttttggtatatagtttttgtacattatttccaccttattaacattatgaaaggtaaaatatgttttagattgtatcagccagcagattgacatgcatatcatccttttaatttgtaggctcggaaaatggagttcactatatcagttcttatgttggtgatggctacttgcttttttatggaacttggcaaagttaatcctcctgctggtggggtaattgaggggctttttatcccaaggcccaaaggggattattctacttcagatgcggttgctatgtttggttctcttgttgttccgtaagtatcactcccacattaaatgattttaatgattatcttagaactatgattatacttttgtctctgaaaattcaaatgaattttctttttcattgccactactttttagttgtacatcattattttcatttttttttcaattagttaacgattataattcaggttttactaatttaaaagttatatatctgttatataaaaaaaaaacctttgaaaggtctttcacactctttaaaaggtattattgtggctaccccgtcagatgtaaagcaaaaggtatatttcactaacttgctctgttcttttataacattaggcataatctcttcctacattcttctttggtgctaacgagaaaaatgccatatacttccaaaggacgcaaggtaaaaggatattttttatgttaaaattaaaattaatttttaacctctggaataggctacttctttttacttttttctctaaactgatgttgattttgtctgtccagtgccccttagtatatgggctataattctataccagtacctctagattattcattttcgtatgagacatagcatatttgaacaaaagttttcgtttactttcatgttattattgaggaatttcaaccatgaatgaataagcatatataacatgaaaaactctatttttaagtacaatgaactctacctaataatttcagtatttcagtattctatagaaagtctatgacaatcctcaaaaggaggtttttttttccctttttctagctctttatatttctgttcaaacagtcattatttcttcgtaatataatttgaattcactttcttgcaggatgcttctacattcttcttgcttgagaatgcattagctctgttcattgcactacttgtaaatgtcgctattgtatcaatatctggtactatatgtgccaacaatctctcatttgccgacacaagcacgtgcagcagtctaacattgaattcaacttatgtactactcaaggtttgtattcaatagaacacttttaggatgtcattgaccttacatttgaaaactataagccttagggggttctgacttctgacagtattttagtattgtggagctaaatagcaatactgaacgtgtagcaatacatgcagtaatcttactgtatacatgtttcacaactaaaaggaaacaccaggccacaaaattatataaacggaaacctaaactagtaaagtgtaccattttactagttcttcctcattctctatctttgatatgtttgtgatgcagaatattttgggaaaatcaagttcaactgtgtatggtgtggccttattagtttctggacagagctgcatggtggctacgagttatgctggccaatacatcatgcaggtacatttacctaattactggagtagattagattagggcctcaaggataaacctagtagtacataccttcagaagatgtatcatctcaatattaccaaataatatttcgagctaattgcatgcctactgaatttgaaatgtaactttgcttagaaaaattgaaatgtaacttctgtgttaaaatatttagttacaactggtaatagatagaaatctggccaagctctagtttcatatcagtatccaaatggggattttctgtatttttttcctccctaaatttcttcatgcaagatttaccaaatgttgttacagggcttctccggaatgagaaagtgcatcatatatcttgttgctccttgtttcaccttattacctagtttgataatttgcagcattggtggtactttacgagtgcatcgaattatcaacatagctgcggtaatttctcttgataatctcttcttatcaactaacataagctaggtataggcacaatgacacaaaaattcaaacaatgttgaataaaacatattatatttcactaataggaactttaaaatccatagattaaacgagtgtaataattatgatatgttctgtaatgtgattttttgtgatgcagattgtactatcatttgtgctgccgtttgctctaattccactcattaaattcagtagcagctgcacaaatataggaccatacaagaatgcaacatctgtaagcttgctaaaacagtttttactattcaatttgtttatgacatactctatctgtttggttatactagtcattttggacacgatcatagtccatttccattacataactttcatttagtttgtatgtataattatgtcctagagaatttatgatatatatataacatgaaaaatatcttttacgagaaatctaaatgcccttatgtatgttagcggataattgtaaattaagaaaaaagatatttttgtgctagatgtatgtaggatcgtacactacaaattattgtatgatacactcttaccagggcatctaaaagttacagatggaacaataaaaaaccaaaatgttagaaccttatttgcccctaaaagttgatatgcacgtccctcattctctcagttacatgtgggtccaagctcaacatgtgaatgtgccaagggcaaataagcactcatggaaaggaatacagtgcagtgggttggccttgaccaaccaaatttcttcaacctccccactgccacttacacaattcatttcacttttgtgaccagctattgctgtacatatgtaaataacttatacgccttacttaccactggtaactatacaactctaaagtagtttgtgctgggaaaaaacactaattagcagactcttttcctcttttctaaacagttgtaaatagaagctataagcatgatagtccccttttcatgaacatttttcttttgtgcacatacccccatttcctcagtgtccactttgcattgagtttgacacacaatatttccccagcttctcttattgataaattgatgtccctgctgctatttttatgtgccaacatgtaaaccataaaatcattggataaataataattagcatctctcatatatatataatatatttttccacttaataacatgccaatgctttttagaaaaggggtgcaaatacgagctagtgtatagatggcaacagaaagaaaaaataatgttagattctagttccagccaggtatatctttatttgcataaaatggagttggtagacagtggtgattgttggttcttccctgtctgatactctatggttgaaatatatttgcaaatctatgtctttcattcatatcaaaatgatttatgggtaattctttcatagttatactcttagaatgaaacactatatcaactagggaccaaatgtagcaacatataatttaattactttgttatgatagtctaagaactactatatggctatccatgtgtagagttctggtgtatcaagtctaggttcatgtgcatgttggaacatgggcgttacatatatcccattgtaagagtgaatatatgagatttgaaatctcaactagaactgtaggctgatcacgaatgcatgttactatgttagagctttcaatttgtaaaattacctcatagcatggtgtttcagtaaacattggagtatataattatggttcaaattctagagtgagagtaatttcaaggtagtaacgtttcttgttgtgttattatattctgcatccatatttttagacaatggttttacttcaaatgaatcacagttacttgaagaattatttccatttaattactagataatcggaaatcttcaacataatttgcattattgcatagaataacttttacttcctcaataacaccatagttttcattattccctgtgttgtcttaaaatggcatacatttgtcatcaaattgaactcattcttcttaactcttgggaattttactcttttatgtagattatccgaatcgcgtggatactgtcattggtgattattggaatcaatatttatttcttctgtactagctttgtcgcttggcttgttcatagcgaccttccaagggttgttaatgcaataattagcagccttgttttccctttcatggcagcctatattgctgctctgatctacttggctttcagaaaagttaacctttcagatccattccccaccaattcagtttctggtgagattgaagttcaacacatacaaatacaagagaagcaggaagatttaggtgtacatttatgaatagaaaaggtaacaccgtccatgtgattcttctctggacatgcatcaagtatttagcatatactgaaattgggacttcaattcatttgaagatgtatatagctcaaagcctcgaaatcatttagaaacattctagctagcaaccgtatgttcagtacaattaggcatatagcaaaacttttctagtcataggtgttgtcctttcgttaattgctcatcaaataaaattctcttccacgccatagattcaaatgtgtgacgaactttactataggtatatggcaaaatgcatggaacaatggtcagatgccctgttttgcaaatatgttttttaacataatggaattcattctggcctttacttcgtagaagttgcaatcaattattatgtgtttgcaggtcgaataattgcgaattacaaaattatagcttgattataaactacttcctctgtttcatattataagactttctaacattaccaatattcatatatatgttaatgaatttagacatatatgtgtgcctagattcattaacatttatatgaatgtgggcaatggtagaaagtcttataacctgaaacggaggtagtagaaaactaccaagaataccaccttaaagacataattctatatctatagttggttagggtatgcataaccgttgtctctaccaacggattacaagttatacgtatttcttgtcttcctcaaaccagaaaagcagactatccgaaaaccagcaaccaatcctttgtcggttgaatttcactcctatattaccatcgactaaccaatgttgaaccaaagtggaataaaacatcagatagtatctgagccgtagatttctcattcaccagatcttactagcacctttgccatcgaacccgtccgatggggacaacgccactggaatatcccaccatcagagaacctccaatacgatgtcttcaagaagttgtgacataatgaatccatcactattctggacatccaaaacaaggttttcacccggagagtctacccatgacacaaatgagagattgggcatcccaacatcgcctccaggaaggtatgtggtgcccacaggcgtcacccatgtcgctacttacatagaagcatggctgcgacgataatggccaaccgggtcgatacatcggagggaacaccaatgccatccacattgccacgcaacaagatccggatcagcgtagccacacaaccgaagttgtcccaaccactcaaggccacatctgaggtcgccatagctgtactgggcactttcccctatagccgaccgccatagccggcaacatcgaagccgtcatgaccacttgtcatcgcagccaaggccgtcaaagctgcc

SEQ ID NO: 781 - DNA, 8957 bp, Oryza sativa
atatcacgcgtcgtatcggttaatttggaagctacacccaaactcccaggacggagacagacgccgcgcgcgcacgagacgtgaggccccggggcacgcgcggccacgctccccgcccgcccagccacgttcccggcgcgtgtcgacgcccacgcgctacatggccgcgcgcgtctccccccccccccccccccccccctgcccgaggtttttgattagattaaccctgcgatcgccgtagcttaggttcgttattaggatacgccaaatgatgaagaaagcattccacacagtgtattaaaaactactgctcctacccatatggctagctaattagggctcgaaagtgataaacctaccccctaagctgttcgcataaactaatactcctttcgtcccataatatttaagatatttttataaaaataatataacatatcctaattctgtcaaaattcataatactataatttaagacattgtatcaaaatcccttatatttcgaataagagattcatagtaaaaacgaaatgtatcagacgaagaggtataaccatgcatggcacaattaatggtgcctcaattttgttaattaattagctgatgctggcgctaaccctgaactgaacctattagatcgggaggttgcattagttaattgactggtttaatctctgttcgtacccaaaatatagcaactggcccccagaaagtagtactgcactcgccttgcacgtagtactaagattccaataatatgaagagaactcatcaacaaaggctgatagtgtagtacaaccatgcataaggagtagtacaaatgatcaaatgcatatctagctgtgttatatccgggtgcaacgtacgtctctaatggtacgtttaatttggaagagataatataaagtgtaactagcacttctgtcaagttggctcatcatactgtgatcaacatactgtgccctatatatatggttcgtgtgtactgataagtagtactactaaattaattaaagaaccatatgcatgagataattgataagtacacacacattttcccctccctgttaacaacagagtatctgcacccacttgaatcaagataacataatctatactacaacgtaaccttccccctgcaatcacattattatcgcatgtaaatatatatatggatcactagttctagttttatcgatatatactttggtaaactacatatataaattaagttgtgggtgacactgacatccatcatctctctttctctccccccattataaatagggaagtcatctccttgaagctagctggcctaagctaactcaatcaaacctccctagcttggcagaatagttaatgttaatcacctgattaaaattagattagtcccctcctacccagctaactactgcttctatttcacggagaaaaatgtcttcctaggctttctctttcagctcgatcgatccacagctcagctagctctctctctctctagcgacaagcaagcatggagcagctgttcgtcgacgacccagccttcgcgagcagcatgtcgtcgcttgaggcggacatcttctccggcgccggccagctgccgtcctcgccgtggctggacctagacctcgacgacgatgtccaagacctctccatggcgccgacgacggcgaacgcggtgtcctccggctacggctccggcggatccggctcccacaggaagctcagccacaacgcctacgagcgcgaccgccggaagcagctcaacgagctctactcctccctccgcgctctcctccccgacgccgatcacactgtaatttaatttacacaaaaccaatcaaatccagtacaccaaattaaccatgcatatgcatgagatcttgatgtgattttgctgcagaagaagctgagcatcccgacgacggtgtctcgcgtgctcaagtacatacccgagctgcagaagcaggtggagaatctggagaggaagaagaaggagctgacgacgacgagcaccaccaactgcaaaccaggagtgttggggagccagctgatgagcgagggcatggctcccatcgtttcggctacctgcatcaatgacatggagatcatggttcaggtcagcttgttgagcaatgtggcgggttcagttcttcctctctccaagtgtatcaaagtactggagaacgaaggtcttcacttcatcagttcatcgacttcctccggatttgggaacaggacattctacagtatccatcttcaggtacacattatacacacagctctatgctagaacgtttaattaatatttcttatggtaatatatttttgaaaagaaaatccctctatactatctccattctaaaatataaaaacatagagcccggacagactgtctatccagatttgtagtacgagtaattaaatgtctcatacgattctattaggttttttatattttagaatggatggagtattttcgatcaacaataacctagcatcaaatcaaggactagagtcaggttaagatccgggtaaattagataaagggtgctatagtacaatctagtgatactactactctgccttaaaatagtttctttttagctatttactcgtatatataccactgttcaagttcataactaaacatataggttttttaagatgaaggtagtagtaaatatgagtaaattttatacaactatgagtatattgaataatattatagaactatacttttatatagcacactgtcataaaattagagacttaatactacacatttaaaccacaataacacgaactatatagttgtatatatggcacaaatctagtatagaatatatcatagaactacatattttaataagccatggatctagtaacacaaattacagatttaaatagtggtaaattttattaaaagttatatatattctaaaatttctatcgaaacaacaatgttagctagggatctactatttacaaattacaatatactattttgcaacaaatttgatgctaggtccatagtttttcataggtggtttaatcttgcaaaattgaaaaaacttgtggcaaatttgcaaatgcccctttaatctaccgtttatgctcatagtttgatgttcaatccataattatgtaatattttgcatagtaacagatgagagaaattataagtgaataagatgaaattctactataatcatgagagatatagtagtccctgaatcgtgtgtggaattcatcagctagttgtttttaagatttcaattagagctgaccttcttatgataaaaaccaatgtttcttagtcacaaatctcaaaatatacttgttaaatcgaagatatatgaatcacatgataattgtaaaaatatatgtagcgttactcatgatactaatacttgagataaccctctaaaaatacgggatattacatatgaaagtttctccttgtttgggttaaaattgacagtagagcatgtttgtgtgtatatatagcgtacaattagaccgttatttagttgtcatagaagttcggtgttctgaaaattactcacagttttcatttatatatatgtatctaatgttgaaacagagaagtgaaggaacgatcaacgaggagtgcccagcattttgtgaaaggttggagaaagtcgtcaggaacaaagcaaagctttaagcactagtaccgcgcgcgcgtgcctatgataatcctgaattaatcaagggccaaaatctaggtaaaaatgaccatgcgcagttgttaaatatagcatttggttagctgataataatgatatataagtagtgtgctcgatttatattaactaatttctatgacatatatactatgttgctcgatgtagcttttgtacatatttcatgcatgactctcagtgtattaattaattatattatgagatttgcaaaatgttaatttttgcaatgcttaacgttgctggaggaaaatcaaaccttaagaatatattactttcgtccgctaatataagggattttgacattttacttgtactgtttggccattcgtgttattcaaaaaaatttagaattattatttattttatttgtgacttactttattatccaaagtactttaagcacaacttctctttttttatatttgcacaatttttttaaataagacgagtggtcaaacagtgcaaacaaaatgtcaaaaatcccttatattaggggacggccggagggagtaagtatgtttccggacatgctatatatcactcgacatattttaaagagagatcatacgaatttctaatcttaagatctacttcacgacctccttctccagctttgacaaactctaccgagctccctagtggtcaattagctagggttgtggagtgggtggtgttccacggtttatagggatgctaattaatctactccctccgtccctaaatattttgacgtcgttgacttctaaatatgtttaaccattcgtcttaatcaaaaaatttaagtaattattaattctttttctatccttcgattcaatgttaaatatacttttatgtatacatatagttttacatatttcataaaagttttttaataagacaaacagttaaacatgtttaaaaaagtcaacggcgataaatatttagggacggatggagtatatttttgcgcaagttatgggaggaaaatatgaggacgcacatcctgaagagtacttaaaagaagataatgcatgcaaatacactgcaacctgcatccatggattaattgggatcttattttttcgcttatgcttatgcttatcaaccaaaatttaaattttcaatcttaaatttggatctaattttgatagttttttcattaaagtttatttttcagcctttgcttttagatcgctaagaatacatatataaaagttttattcacaaattatttttcgtttgtaaatatgtcgtttggcttatttcacgaataagcgaaacaatgacgctcttggattcttctccttaggtactactctctctattctaaaatgtggtgtactactagtatttcatctgaaaattaaccgagcaccagctgacagtacttgcacatctacattacagtatgtactagcagaagtaaatgtacttgcgcgctctgtactagcaaccaggagcaagctgatcgtactcacatgcaacaagtttgtggataaggcgtactcctacgtttttgcagttaattaacataaatagggcgagagaggaggattagtgtaattatatatgcaaagactaaagacctttcctgcaaatatttctgaggatgtcgaaggtgttatcaaaaagtgtcttttccattgcaattccagactaggcacaaattaaatttcgtaggctttgggggctttctgcgtgttatgaggaccaataatgaggtctcatcctagctaatttgctgaaatcggccgagatcttatagcagaccatatggaccgcatcatagcatgaactatgcttaggtttggctcttactttaaccgggtaaagagttgaatcgtaccaaacatgtcacgagccacatccaaatttgatttttttttcgcaaacgtgcaaaaaaattgcacgtcaatatattagaagaagagagcatagtttaattacacaacacacacggtcagaaggccgttgccaggggtcaaagaaaaaaagaaaaaaaacagataagctactaagaaagtaaaaactcatatcgcaagagagggtggggtagggggtcctactacactctggcctgcgccagaggcagcgagtcggagaagagagaagagaaggtcattgcgtgatctggagggaggggttgagagaagaggccgttgtaagccgcaacagcctcagttgacacaggacccttctcagacaccattccaagcttgcgcttcagattgtgctaggcgcgtgaggtcatgtcactcgggcaggcgagcgcgagcttggccgcaatcctcttgctacttttcggcacttcttccacggtggcatgcaattcgtggatccggtggcactaatacagttttgagatttcgtggatgatttcatctaaatgaagtccaggatctggtggcgattctatctatattgaagtccatgacatttatactctctttgtttcagactataaattcattttgactttagtcaaagtcaaactactttaagtttagttaagtttataaagagatatagtactcatatttacagcaccaaattagtttcattaaatcaataattgaatatatttatcttgggctaaaatgttactattttttcattaaacttaattaaacttaaaacaatttaactttgacaaaaaccacaatgacttatagtctgaaatggaggaagtatcgtttaatttgagactttgaatacttaatttacaaagaagtgtgtatttgtgccgtgttttctcgctctatatatatcgcagtttcacccatctaattagttgaacagtgcgtcttaatctcaatctccattcgccaattgactgtacatgtctgaatggaatccttctatgtattatctgcacagctagaatcctacaactagcgtagtgtggtggtggtcgtcttcgagttcgacgcgccgccgccgccgctcatcgcgacgacaagagcctcgccagcgtccgcagtagcagcttcctagtcttgttgcactccgagatcgtctccagcctcggcgaccacggctggttcctccgccccatcagcagcgcgtaatgccgcttcagctccggcgtgctgcacagctccgtcgccgtcgccgtcgccgtcgtcgacggcttccggcggcgcgcaccgccgccgttctcgtcgcagctgatcaccttctcgatgaactccgggaggactcggatgagcgtggcgccgccctcgcccttgacgtactcgaacgggcactgccccggcccagccacggacaccttcttcgacggcgccggcgacagcgacgcgagcgccgcggcggtgagcaccttgaagcaggagaagcgctcggcggggaggacgaagtacgtccgccccgccatcagctcctcgccggcggacaccaccgggatcgggaggccgacgtagaaggagtcggccgcgcagacgacgtggtcaccggggagctccgccgtgacgtcccccgccacggcgcacaccccgccatcgtcgtccagcatcctcgtctgcccgccccagtacaccagcttcacccccgccgccgccgtcgccggcaggtgcatgcacggggagaggccgttgcccatggcaactgatgtgtctagaaccttctagaacgagctcgagcttgcagatggaagaagaggagaagaggagatgcttgtgtgaattggggctcgtggttgcgagaggggaatatatataagcgagcgttgaacggggttgactttggaaaattcaaagatggaggaggtaaatactcctactactactggtctggcttggtcagcggtcaaaggcgatggcttttgagacggaagcgggtcacgtggcagctgccgattgggccgcggagggggagaagcgagttgcgcgtgcgcatcgtcgttggtcggtgtcgccgatcgggttggatccaaccagatattcagaatttcagatcagatgcacagtagtacagttgcaagttgcaactagaagttgccgattaatttgacagcgcctggctgcaggctgctaccgcactccaacgccgacatggcaggtgtttttttttaaaaatcttgttccaaatttggagctgactgaagagagttttatactccgtattatgggtatgagttcatttatactcctatgtcacttatcatcgatttgttttcggacttattcactttgtagctattttcaaccattacaaaatttaacaattcccataattttagcaaattaacgatattgttaagttttggtaggatagactaagtgtgatgttgctaaattatttatacatgatcaatattttgtaacaaactaaataccattatatatttatcaattttactgaataatgttatgatttaaaatgaaatcaatctgagcgtgtcatcttttaaaatttacgagttctaaaacgaacctaactaactgtatgtaacatgctccagccacagtaaacacacaaaagaagaaaatggcgtgcgaaatttgtcccaaaaaatccatctggctaacagcgcactgtttcactttcacctagcctgccgacttcctaccgtagactaccatacgactggaacgaccagtaatactaacttttaagtaatatataattttagcatatgcaactcgcgtcgctgtgatgatgcgcgtcttaatttacagttcttgttgccgactagtactacactactactccttgaacctaatccagtccaatattcatggcacccgttgtcatcgtcaacaccaagtaaactgtgggcgagacgagagccctgtactttgatctccggtggctgcaaacctttacaagttgtgttctatgattaccggtgccaagttcagagcatcagtcaaacgtaatctgttattactagtagtactacttctcttagaaaatataaaacgtaacctgttacgtagtatacgtatacttctctctccgtccgtatcattttaagtgtagttgtaggttttcgtatccaacttttgatcgttcatcttttttttatgattagtatttttttgttattagatgataaaacattaatagcactttatgtatactttattttttaaaatttttaaataagataaatgttaaatgttagaacacaaagattcaccactgcacttaaaatggaagtagtaagatcagagctgtttcaatcaaagatcagtctggccaacgctgacgccttcattcagaaaagtggcttggctggcc

SEQ ID NO: 782 - DNA, 4122 bp, Oryza sativa
gcatagccattatccagtcaccaatatccccattgttttacttatgcttacccttctaagccaaaatttaaattttaaaatttaatttcagagttgattttaagggtttgtcatcgtaatttattttacactatttgcttttgaacgctaacgacaagtatacagaacatttatcataaataagattttcttacctataagcgatatggataagcataagtgaaacaatcgaactgcaaaactactttgcgtgagagatgatcacgagcacttcgatgccaaacttcacaacgctgccgactataaatcatcgtatatcactaactttgtgttcatatatcgaagaaatatctatttctaaaaaagtgcctattttcaaaactatacttaaaaaatttaaaatctaaatcttttcatgtatttggattaggggctaaaattttagtccatgtcacatcggatgtttgacactaattagaagtactaaatagagactaatgataaaacccattccataacctagactaattcacgagacgaatctattgagcctaattaatctagtgatactacagtaaacatgtgctaattataaattaattaggattaaaaaatttgcctcgtgaattagctcttatttatataattagttttattattagtctatatttaatatttttaatatattagtcccgatatccaaacaccacctttaaaaaaaaactacggaggaactgggatagttgatgcgcaccggggcacgcacgcgccgtgcgttgggcgtgtggcgcaaccccacgcaccggcacgcgccaggccggcgctcccgcctccagaggccgccaccggccacgcgcccctccacgtggctcctggcccaccaccagatctctccaccgacccccacagacaggtgggcccgttcactcccgtggcccccacgtgccagtgagaaaccacccgccgccgcaacgcgcgcgccacgcgccgcgtcgtgcccctcccgcgcttgactcgcctcgccgccctctcccccttgctgttattgctcccttcgcggctctccttcttcttcttcaatcttcgccctcctcctcctcctcgtacgcgcccacgcggttctctttctgccccctcgatcgatttgaggtttgcccttgtttgctgtgatgttttgcgctgttaattgggtgattaatttgggggggtcgggttgggttgggtggatcgatggctgatgggttctttcttggtcgattggttttcagcagggaacggaagggggaggtttttggaggaggccatggtgccgtcggagaggggggacgtcgccaccgccatcagacccgccgctgccgacaagctcgtccatgggtgagtgactgaagtttcttggttgtctcgtttggggacttgggggatagttcttgttcttggaggaagcaaagagatagatgctctggggatgctaaaatttttgtttcatgatttgtctcgaggcgcagtttgtttgttaggcatcataccatagtgaatctacagaattagtgatgatgctcactactcaagcagcaaccctgcaatagtaaatgtggaagcctgccaatcatactgcgttagacgccgttggtggcgtagagctatatagtggtattggcaaattatttgtcgtcaggtttattgacttagttgttatctctgcatgtcgatttaattcttatcccttttccatttgggaggaaatgaaagttgagaattgtgcattgttgctaatgttgtaagttcccattgaaaccttgtgcaggcctatctctgacaagaagtgccggaagaaggtcccgaggaaggttcacaaatctgagagggagaagcttaaacgcgggcatctcaatgatctgttcggcgagctgggtaatatgctaggtaagctgttttgatcacaaggcattgcgtcagttctatgtgtctgaattggaaatttattatagcttgttgcgcagaaatacaaaccacatatctctctcttgaatgtcattatataattcgtattactagcaactggattcatcattgcttaaatttgctgctatttagcatctgatcaaatacaacaaccttctgcagaagcggataggcagagtaatgggaaggcatgcatactaactgacaccacccggatcttaagagatctgctttctcaagtaaaatctctccggcaagaaaacagcaccctccagaatgaatctaattatgtaagtaatatttgctatggaaaaaaaaaactgttgatttgttgcagttgtagaaccatttccctttctttggcgtgcttgatgatttacattgctaacttgtcgtatgcataatgcaacactcattccaacattgttttttctcccacaaacaggttacgatggaaaggaatgagttgcaggatgaaaatggtgcgctacgcagcgaaatctctgacctccaaaacgagctgaggatgcgtgcgacagggagtccaggttggggccatggcgcgactggatcacctctccccgttcctccctctccaggcacggttttcccatcgcagcagccaatgcagccatctcccatgacaacaagcacagtgttccccttgcagcagccactgccacaaccaacagtcattgagccctctgcaagacagccactggaactgaagctcttcctagaagcaccccccgccgaagaccctgaaccatcagaagaccaggaggctccgaacaatgtggcacgaccgcagccgaggtacccaacagaggcatcttcttggcctattagcctgggacttccaagaatggaagatgagcaaatgtagtggtagcacgatagatgatagcacaggtagagattgagagggtctgtttttaatgcatgcaggaattccacacgaaaacacttctgtccttgcatgaaaactggaaaatttcctgcattccaagtaagacctgagtagatcagctccaaccaatcagaaactcactttgagcctagaggatatactactgaatgatgtgcatgtaaatatttcaatctcccttttgtttctgtaaactctagtgagaatagaacccgttttatccccttgcaaatattgatgtccaattaaaatgcatttatgcgataattgcaatcgaaggaaaagttatgaaagaacaaaaattgtaagactatacgcctgtaaccagcctccaagccaacattatcacaattctatcgagtctgacgaaccagcaacatctcaatacaactatgcagcacctggcaaccaaacaggctgatatatagtagtatagcattaacattgaacacttgaatattttccattgctgttattcagaagaacaatccgtacaaaattttatgaactactccactccgtagctggaaaaagtcaccatgtcctttcgcacataatgtatctactgatacatcttcaaacacaccaacggaaatacgcgagagattatggccggtttcctctgaatggcgaaccagatgcaattgcaggtggctcttccctgtacggctgagtagcaggatcagtcacactgggcagtctctgtacgctccccttcccttttctagcattagggccaatttcttcgatcatgtacttccatccgtcaataggacgcctccggctaaatatgtgtgttttgatgaagctagcaatctgcagtcgcatttcaacaccatgtcagaaataactagaataacacaaaaaaaattgtggagagagagtgattgtggacctgctgtttactgaaagcaatccgcctttcgaattcttggagaagaatgtcatcttcccgctgtgagatatcccatatgctaccatcctgtcctctagaggtggtttcccaaccatcaggcttggttttgatctcagcagtgcttggaatctttgaatcgccaaaatctgtatttccagaatcgaaaatcctgtatttcacaaaattataagccagctacgtgttatagattgctaagcattttgctcacatgaaaaatatgcattcctaacttagcaaaaccaagagcttacggaaactaaaacattgtacaagccataaagcctccccaatcatg

SEQ ID NO: 783 - DNA, 6900 bp, Oryza sativa
attccgaaagctgcagttgcttacttgctttattcatcaaataaccccgtcagtgtggttttggttatttttatatagtcttctacaaaaatagttaattactctctccgtttcaaaatatttgacaccgttgattttttagcacatgtttgactgttcatcttattcaaataaaattgtgaaatatgtaaaactatatgtgtacatgaaaatatatttaacaatgaatcaaatgatatgaaaagaataaataatttcttaatttttttaaataagacgaatggtcaaacacgtactaaaagtcaacggtgtcaaatattttgaaacggagggagtatatatattctgttactctatgaatattgatcacttaatataagtagaggcctagagccggcttaacaggaaaacatgccaagttttgtagtgcgaaatctagcatgtctccagattctccatcgcaatgttttttgctgaatttcctcatgcttttttcccggttcaaagtttgtaaaaatcaagctatgaaaaaaatatcgtcaattcgttaaaaaaagttttaaaaaatagcaggttaatgtacaaccaaaagttactttcaggttaatttacgagcttactataaactgaagttgaccacgttaattttttttgcactgccatgaaacacttgtggtttaatgattccgcttccttattagagcacttattaagaaaaacaagaactaaccatattggggttttgactttgccgtactattagtgagcatttttcctcggtacatatcatcagcttcggattcaacaaaatcatgagtagagcattgccgaagtgaattccacatcaatgatatgacggcaagaaaagtgccgccactgattacgtaatatatagtgatacacaataagaatataaagttcctagacaagtggtgctcagtcaaatggaaccgcgattaggatatctatagtagaacgataagatttgggaggaagcacagatagaatgcgtttgtgtgtgcatctctactgcagcaaacatttatagaagaagcaaaactagtccaacgcatgaaaagtaatccgggaatttctttgtgacaaattggacacaaaaaatcttgtacgtatatcgtagaccttttccagagctcgtgggtataaatacatgccatcgatcgcagttagcatcacccctgcatcactcgaacttgcaagctgcagagctcacgttgagcagtgagcaactgttccattggcgcactgatcgaacgagcagtgcgaacttgaggtgaagcatcctgccgtgttcatcgatcttggcccaaataatgctcgtcggaattcgacgtcgctgaagaggagataatcaattccgtgtttctttcttgtcctcgtggtgcagatcgagcagctaagcgagatcgacgccgccgccgccgccatggagcacgccgacgcggaccgcacgcgggtggcgcccgagatcgggagcctgcacgacgaggacgcggaggcggacccggcgcgggcgcgggagatggagcggctgcagccgtggcgggagcaggtgacggcgcgcggggtggtggcggcggcgctgatcgggttcgtgttcagcgtcatcgtgatgaagatcgcgctcaccacggggctggtgcccacgctcaacatctccgccgcgctgctcgccttcctcgcgctccgcggctggacgcgcgcgctggagcgcctcggcttctcgccgcggcccttcacgcggcaggagaacaccgtcgtccagacctgcgccgtcgcctgctacaccatagccttcggcggtacgtcgccgggctgcagcctctgcgtcgatctcttattactatataggcagagggttccatttttggaacggaatttccgaaattttgatcctccaatagaatattctttcggccatttttcaagaaaacatttaaatttaaataaattttgtttaaatttaagtatttaatttcgtccaaaacatcttgagattcccacaatttctaaaatttcgcttctatcagtactcctgaaatgtttttcaatttcaataacttgactctaagcagggttttatatttcaaaatggaaaaaaaaggaccgaaattcaaaaatttggaataactttcttgaagtttgaaacatattttagctaatttatacatatgcgaattttttttaagctttgggctccaccgtcgttgttagttgtgtagcggtgggtttcagccagtttccttataattaaccgtgcaattgtgtggttttcggatccggttttccttataaactgtatcaattctcttcttctaaatataaaagtggaacaaagttcattccgccttatgtttcaaaatttttttttaagcagagccaatcttagtgaaattttggaaaattgtaccgataccaccgtaaaacctgaaattttggaaatttacaccgagaatgtgaacctcacatagatgttgatctgtgctctgtattgatcgatcggtgtgagtggttcatgcaggtgggttcggatcgacattgctgggcctgaacaagaggacgtacgagctggccgggaactcaccaggcaatgtgccagggagctataaggagcctgggattggctggatggtagggctcctcctggctattagcttcgcgggtaacctcagcttgattcccctaagaaaggtgtgcctttcttcccttaatttgatccacttcggttagttctttttaattgtttatagaattgttgaaacaaattatttacttaatgtttgaaaattgtgttttctgataaaactttctactagtgtactgtttggatcacttttaaaaaataattcattgtatatatttttagagcctttagaaaagtcatccctattatctaatatatcatagattaataaaatttccttaaaaaggatattcagttatcataactctcttgtgtgaggtggctaaaaaaaatcaaagtgttatctcactttccatggacccctacatgatagttgttggtggtggattggtggctgaacactaccaccacaatcttttaaagcagtatagatttgttaagtttatttattaaaatattttctttatatatacacacacatatatatatacatacatacacacacacacacacacacacacacacacacacacacacacacacacacacacacatatatatatatatatatatatatatatatatatatatatatatatatatatatatatatacacacacacacacacacatatatatatatacatacatatatatatatatatatatatacatacatataaaagtagattattcgtagcaataatccgctcaataatgatctgtttcaaactgcgccaccctctcctaatttctaaagccagttggttgacaattgacaaagctgtcataaactcagtaagaaaatgcaatcaagtaaaaaaaaacctttggaaataacaaatccaagatgcagttggtacgtggcagcaatgtaaaaaaaaaaaagcagagcccaaaggatgggaacattcatggactacagtagcattatataagtagtgatgtgacacaaaacattttttaaggataaaaaataggtctcaattatctattcctactaaattaattggtactaaatgctttcaggctttggtcgtagactacaaattaacttatccaagtggaactgcaacagctgttcttatcaacgggttccacacagcccaaggagataagaatgcaaagtatacgtgttttcacctcaattaattgtgctcattgcattattcttgttagacagtcgttgaccctaaatgaactaattctgcaatctgcattcatgacagattgcaactccatgggtttctaaaatattttgggcttagcttattttggagcttcttccaatggttctacacgggaggcaatgcctgtggatttgttcagttccctacttttggtctgaaagcctggaaacaatcgtaagaattatatgctaatttcctaattgttcatcacagatttatataaattgtagcatgcggtgacaaattttctaagtctgaatttgtttggatatcagattcttctttgattttagcctcacatatgttggtgcggggatgatttgctcacaccttgtgaacctctctaccctccttggtgcggtcatttcatggggaataatgtggccacttatcagcaaacataagggggactggtaccctgcaaacatacctgaaagcagcatgacaagtttgtatggttacaaggtctcatattttctcaatgcttaatgtaaaagcagatactacttacaaaaccatcagataacttatgtaaattgctccttttgcagtcgtttttatgcattgctctgattatgggggatggcctgtaccattttgttaaagttaccggtgtcactgctaagagtttacataatagatttaaccgaaaaagtgttagcaacacaggtgagaaaatgaaaccattgcaaattcaactacatggaaatggaatgcctctcacactcttccatcaccttaattttcacatactcataacactgttaatgatggctaaatgaaatgaattgcagcatcagaggagggtgatatggtttcattagatgatctacaacgtgatgaggtattcaagaggggtactgtcccttcttggatggcatacagtggttacttcttgctaagcatcattgcggtaatcaccataccgataatgtttcgacaagtgaagtggtactacgtgatcatagcctacgcgctcggcccggtgctaggattcgccaattcctacggagcagggctcacggacatcaacatggggtacaactacggcaagatcgctctcttcgtctttgcagcttgggctggcaaggacaatggcgtcatagccggccttgtggttggcaccctggtgaagcagctggtgctcgtctctgccgatctgatgcacgatctcaagacgggacatctcaccttgacatcgccgaggtccatgctcgtgggagagctcatcgggacaggcattggctgcttcatcgcgccactgacgttcatgctgttctacagggcgtttgacatcgggaaccccgatggctactggaaggcgccatacgcgctgatctaccgcaacatggcgatcctcgggatcgagggcatctcggcgctgcccaagcactgcctctcgctctccgtcgggttcttcgcgttcgccgtgctcacgaacgtggcgagggacgccctgccggcgaggtacaagaagctcgtgccgctgccgacggcgatggccgtgccgttcctcgtaggggcgagcttcgccatcgacatgtgcgtcgggagcctggtgctgtttgcttggaacaagatgaacaagaaggaggctgccttcatggtgcctgctgttgcgtctgggctcatgtgtggcgatggcatttggaccttcccttcttctatccttgctctcgctaagattaagccaccgatctgcatgaagtttacgcctggaagctaagaggtgtagtgtgtttaatttcatgggtggaggattgcagaaataaacagtgatgattaactgtaaatgtgtcttttggttgtagtgagctgctgtttgcctatgatccaagtcatgtttgtgttttaatttacctatcgaattagctgtgtttgtacacttgtacattttataacttgagaattgtttagtttggcatacataaaatatgttataactttttttactcacatgtataggattgatgactactacactgtaatctcaactaaggttgtgttcgagtatcaattattataatctttaaaataaatttgtttaattcttctcttagaaactcttatataatttttttaaaaataaatgtaccatttagcagttatggacacgctaacgaaaaaataatttggaattgtagtttagaatggggcctaagcataattgtaaaggcctcgatactaatagggttcacaattccgacaaaaaccggtcaaattccgtaaaatttcaaggtttcgataaggctcgaaagtagataccgtctgagatttcaatgaattatatccaaattcaaatttgaattgataaaaaaggaaaatatcaaataaaatattatatatagtatgatattcatataacatattgggatataaattttcgaaaaaaataatatatttcgtgtatttactaaaacttacggtaagagagaaaagaataacgaattaaaaaaaagaaaagcactttcagttcacctctttttctagttaccaattgaaatttcgatgatttcactcagaatttcatcaaagccaactggtaaagtcaaggaatttgtattcaaattttgctttataaaatttgttcggaatctaccggctttccactagatttcgcgaaaaccgtcatttcgctagagcccaaaatggaagaccatctcagaatcataaaccctgtttcttatacttaattaatgtctagagaagtttagtatagaattactacatgtaccccactcctatatctgctcaagtatcaatcagtgggcaaaagcatgtactaattattatcttatgaaattgaatagtactaaatatagttaatgctctatagaaaaggagttcctcttctatgtaaatgtggtatagtgtgcctccgtctatccgtctttgtctagtacctttgacatcaataagacaagagacatggcaaagtaatgacatgtgcttctatcttgtttgatcattcggtttatcagggaaaccaatcatctatactttcagaggatctaatttaatcccgttttacaagttaggtgctcaaga

SEQ ID NO: 784 - DNA, 4648 bp, Oryza sativa
agcatctctggaagatcatgtcatgtcttatttcctatagcagaataactgaagtgtagagatgatgcctctagagcggcttgtctatttatacgtgtacccaccgctggttatgtattgtcaaatattgaaatactgaaccattctttttttttcacttttgagaatcatgatcattttgattgatagtgcgaagcagcttccaatgtgcaactaggcttgacacgttatatttgttgatgtgattcgttcttcataatccagcgaagcttgttctgcttttggactgcattttctgaaaagttacatcttttctattgctaatgagacagaaaaacctattccatctgtactaagataactttattttaacatctaacatttgtcccaaaacaaattctatgctcttacctatcattcagtctaaaattaagtttttatcatttcagtatctcttatctacccatccattaatataacatttctattaattagtgccacttttttctgtgctaatttgaacccttatgtctgaagttattttgagcccttatgcctgaagttattttgggacagatgtaagtacataaaataattcttaaaattgtactataattaagcttcggggtataatttagatagtacgaagaagtttcaaccctctcttaattgtagaaaatgactagcatgatagccatcgatatggatgtattagaacgccacttggattatcacttgctctgatccacatcgcatcgacactccgagaagtcactactagcggtgaccgttaagattaatctgtgatgtaacgcaaagaaccaagcctatgactgcatgagcttggccggtctcgctatgctacaaaaccaggatggcgtgatatgggccgcctccccttctccttagatcagcataggcttgagtaacggctctccttttcccgtcaaatcgcaaatgaacttccgttacgatccaaaaacaaatccgagaggaaaacgagaacgatcaggcgcgatgcgcgcctcaaaatatccaccttttcctcctcttttttgagaaaattctgcgaaagcatcgaatagttttgtactggtcaccgacgacaaccaaataaccaaccggtgtcacggcgaattccgtcaacaccgcacccaagtcgtcgtgtttatatatgctttgccaatttgccataaaaacccccacgaaatcctccaatccattgccgcagtccgtccaagagagggggacactctgcctccagccatgagcgacggcggcgcaggcgccaagggcgcgggcttcggcatgccgcgcgtcggcatgggcacggcggtgcaggggccgaggccggagcccatccggcgcgccgtgctcaaggccatcgaggccgggtaccgccacttcgacaccgcggcgcactacgagaccgaggcgcccatcggcgaggccgccgccgaggccgtgcggtccggcgccatcgcctcccgcgctgacctcttcatcacgtccaagctctggtgcagcgacgcgcaccgcgacagggtgctccccgcgctcaggcagacgctatggtatgtatgcccccccccccccccccccttctctttgcccccgtataagattccggcggaatcaagtgaagaattgtgattttagtagtggattattacgagttgtttggagtaatcggttgggccaggcctataagaaaaacaaaggcattatcttaaataaaggaaaatttattgtggaattaggatatgtgatagggaccacctatacatttgtcgacaaattttctcctaaaaatttgatagatgtaattataatacaattgtagtgtaattacactgtaacttgcatataactatataactatagtgtaacttgtacgtaagtttcacgtaattttgaattgttagatctattataagatttgttttgatgaggaagaaaaaaaatcacagcacacacacatgtgaaatagtttgttcccacaacctctattttaccaaaataacatgttacggagagatttttaaaagttacatagaagttacattatagttacagtgtaattacatgcatgttacagtgtaattacactatgattgtactgtaattacatctgtcaaatttttgggggaaaatttatcgacaaatatatagcaaaattgtatgtgatattattctttaatcttaacaagacaaattataaaaagtcttactctttggttgtcgtgctgatgctcatctttgagtataggaatgccttgagtatatcacgtgccgaccactcctatgccttgagtatagggatgccttgagtatctagttggtaactagtttctaataatttaaaaaagctagaaaacctaatttctaatttctagtttattttttgaattttgaatgtagttgaaaaaccaaactgtttgagtgcttttaattttggaagatactgcattagccacgagacaaattctttcattaccatcttggctgccacctccaaacagatattagtccctcattaactgcagtgcatttaatttctatctgaggcaccatgcgactaatcaactgattatgaaaggttaagactcaccttaattaacagaaagcacatgctcatcccacacgtatatatgcaggaaccttcagatggagtacgtggacttgtacctggtgcactggcctgtgtccatgaagccgggccggtacaaggcccccttcaccgccgacgacttcgtgccgttcgacatgcgggccgtctgggaggccatggaggagtgccaccgcctgggcctcgccaaggccatcggcgtctgcaacttctcctgcaaaaagctcgacaccctgctctccttcgccaccatccctcccgccgtcaaccaggttggtttgcacaattcacaatgctgcaacaaccaaaaatgttataacctttttttaatggttgatttgcttattgtgttgggtttgcgttgcgtttggtttgtcacggtacgtacgtacgtgcaggtggaggtgaacccggtgtggcagcagaggaagctgagggagctgtgcagggagaagggcgtccagatctgcgcctactcgccgctgggcgccagcggcacgcactggggcagcgactccgtcatggcctccgccgtgctccgcgacatcgcccaatccaagggcaagaccgtagcccaggcacgtcacgtctacatttgcacgcgtgtgttcgtgtcgcgccgtcgtctcagcagcaactgacgtgtgtgtgttgatttggcaggtgtgcctgaggtgggtgtacgagcaaggggactgcctgatcgtgaagagcttcgacgaggcgcggatgcgggagaacctggacatcgtcggatgggagctgacggaggaggagaggcagaggatcgccggcatcccgcagcggaagatcaaccgtgccctccgcttcgtctccgaccacgggccctacaagtcgctcgacgacctctgggacggcgagatatgagcactcgccggcgaccgcttcgtgtttccaggcgccggccgacgtgcgtgctgctctgaggaacgtaacaacaaaaactgcggctcttgacgatcgtgttgaataaagcaaagtgtgacgatttcatcggctctgattgcataattccggagtgcacacgctagcacgtgcgagagagagagatataggtacatcgagcgtgtcaaatcgatcaaaattgttatagacgaggccgagccgagccaaggaaaagcttccattagagcatttacagtgcttcttactcgcatgccaagtctcacatgtcagttggctcaagaccagtattagacactcgtgtcacaatactgtagccttaagtggggtctacaaaaatacagaagtcccttctctcctcttttttcccctctatcatgccttccactctctctctctctctctttctctctctctttccctctcacgctcgagcggcgacttgcacgctctcctcttctccttccactgtggcggggcggccgggcggagcagcagcctaagcggcaatagcgtcaggagaagcggtggtccgagcagtgatggcgctaggcggggcggccatatccgatctgggctcgctagatctggccttgggcgatggcagcggctcgtcggatctcccctctcccctcagcttgctagtgccaaatctcatctcccctcctcgtcggcgcccgttgtccaaggcgacgacgacgagcggcggcgtggcctataccctctcctcggtggcgccttccgtcctcttctccgtccggcagccctcctcccttggccgtcgtgggctatccagacgaatccctgacaaatctgacgagaaacatgcgactcatttaggctccattttcttcacttggtaacggaaacatccgacgtggcgtggaatcttggctggggctgcctaaggttgaatgccagttatacgcattgtgaacgccggccgtgccatctgccaccggcacgtacgaaccgaacgtcgctagcttttgcgtcgtcgcgtcgtcctcgtcgatctcggcggaatcaaccgcccaaccaaccgaaccgcgcctcgtctcgtcacgagccgccgtgacagcgtcgtgccggtgc

SEQ ID NO: 785 - DNA, 7505 bp, Oryza sativa
gaggcctcatattttagggtggctttgatggagattttcagacgcaaatgaaacaagaaaactcaataatacatgattagttaagtattagctattataaatttaaaatttagattcattttatttttctaaagaaaacttttttatattttttccacaaaaaattttgtttagtcgtttaaaagcgtgttaaccaaaaataagaaagttgttggttgaagttaccgcctaaaactcagtcttactcagaaactatcaagtagtttccaactttccatacttaccatatcatttagacagtatatatataaactatatatccaatggattgtgtctttaaattaaattttcatccaatcatcttcattctctctcattttatcaaccaatctctttatttttattcttggttcttgtgtagagatggtttcttgaatgagaaatagtttcttcatctttttatctctctacttattaactctcttgccacatcagatttttactcatgtgacaatatatttaatgttatggatactagatgatatgaaggattggggatagccttagtgcaatggtcacataattcttttccataaagaatagcagcaagcattcgtcactcagctcaggggagaaccaccgcatagcatgcatggatcatgctttgccgcatcctccgtgacgatatacggtccacaagagtccgaaacggtccccaaaaataagccaaaatgttgccggggcttgcgtctgaccaacattgatcgatcaggtcgcaatgggcctctatctttatctcacttcccattaacacgtttattaaatatatgtttcgtgcgaaaacctttttaaaaaatatataaaaatactaaataaatttatttattaaatttataaataaatttataataattatctcgtttggcgtgctccgaaaaatctcgcattcgtatctaattcgagtcgaacggggcttatatactcctcgtgcaccaccaccaagcaccaggcgcgcatgcatgcttcatgctgctgtgccccacccgagtccgtgtcccacacccgtagaatctcctacaaatatagcggcactagctatccgacgcgcaccaccaccacctcctcctctgcaccggaattcaccaacaaaaaacagagcacggccatggcaccgacgacggcggcggcggcggcgagcagcaacggcggcggcgagagcgacggcagcagcaaggagtggaggctgacggcgccgacgaggggcggcgcgatggcggcggcgggggacaagatgagcatccgggcggtgcggtacaagatcagcgccagcgtcgacgaccgcggcccgcgccccgtcctgccgctcgcccacggcgacccctccgtgttccccgagttccgcaccgccgccgaggccgaggacgccgtcgccgacgcgctccgctccggcgacttcaactgctaccccgccggcgtcggcctccccgccgcgcgacggtaccacccacgccatccacttccgttttttttttgttttcattattttccggcgagttcaaatattcggttttggttttatgttttttttccgcttccgtttctttgccgattaattgttcgctacgtgtgcatggttcatgtttgccttttatggcctttattaaaattagtttattaaattttctcaactatttgtttgttaacgagaactagcaagctgagccgaggcgagccatatatagtgaggccagttttcgttcaaaattgaatagtttagtttaaaaaatttatcaactagagtactttcgaatcgagccagtgataacacgtatttactaatagtgcttattttattcattaatgataattataatacgaattatacgaatagtgtttagggactggttggttcatttgcttattttgtgtgccaaacagcatatatcaccaatttagcaagctatagtttttcgacactcgacaaaaagctcgccacacttatggccaaaataaatcagcttgcaaattgagtctataagcaaatctaaaaacgctacaattgcagttataagccaaacgttttgccagaagaaccggagctgcctactttagacgtgataaagtttggcaataaactaaaacagtcccctagtctgcgtaccattctttgtttactaacaaaagcgtgctactttacccaccagttatataatttgttcactttgatccgattcctattttgcaacatgtacgggtgatatatatttcatatacacatcatcaggcacctataattaagctgcatgggtcttctctgttgtagtgagcacactttggtcataattttaaggactgtagcactgaaaaatagatttatttgaattttttaaacaacttgcacatataatttttttatgaaaatatataattttacagtttgaaaagtgtgctaatgaaaaatgagaaatttggagttcagagttgaaaaaaagaaccggcaaaacaacaaccccatatgcaacacgaggtcagtagggtcacaactcacaacctccctgtaatgtaatcccggggaagatttgtttcgattcaaacccatatagaaccatggatttaattgaatttaaactggatgaagaaaacaattattgaagtagtgttattacacatgtcacatgtgcgcgaatactgtattggcgtcgatctcgaggcgtactactcccgtggtcggcgagagctagtaggggaggagaactgaagtggaaccaacggctggcgatggacgggacgtacggcccgagcggcgcacgcgcccgcggcgggggagcacgagccccgcgtcgtccacgcccgcccccaccgcgtgctggcacgccccccggctgctgcggctcgtccgacgtggcgggcgcacagcctggatggagccttcattgtgcatctgtgctagctgtaggactgaaggctgtagctgctggatttctgggggaaaaaacaaaagaaagaggaggaaaagaaaggaaggaaaatgtgctctcttttgaattgagaacaatcgtgccttttgtggactagaagcaggggagaagaatatatagtccaataattcggtttttctgggttgatgatgcatttcttctttagaaaggattttacatgctgttttttttaataatggcatgttgttcattatgttttttttttcatgtatgattattaattaaatgttttatttgcgccgaggatgcagttcttcctgaaagaggcatttacgtgatgttggttcatgcttgcttatgtgattgttaattatatcataatatatcttgattaatcttgtgcctttcttttgaatatagtgctgtggcagatcatttgtcacgcgacctcccatacaagctatcttctgatgacatcttcctaaccgctggaggaactcaggccatcgaggtcgtaatctcaatccttgcccaacctggcacaaacatattgcttcctagaccaggctacccaaactatgaagctcgagccgcgttcaacaaccttgaagttcgtcactttgatcttattcctgagaagggctgggagattgaccttaactccctagaatctattgcggacaagaacactactgcgatagtcatcataaatcccaataatccatgcgggaatgtgtacacttacgagcatttatccaaggttcagctggtttatttaaatttgataaaagtttaaataatattatgggcaacttattaatgtgcatatgtattattgttatttaggtggcagaggtagcaaggaagcttgggatattggtaattactgatgaggtgtatggtaatttggtttttgggagttccccatttgtcccaatgggttgctttgggcacatcgtaccaatattaaccataggatcgctatcaaagaggtggatagtgccgggatggcgacttggttgggtagcaatatgtgaccccaagaagactctacaagaaaccaaggtaaaatatatatttaatactgttttgatactttttttgtgaattgatatttgaaatatatatttttctaagtgtatactactttctttgtagattgcaacattaattactaatttccttaatgtttcaactgatccagcaactttcattcaggttagtgtttttttccttaacaagccaatgtttgggttataattttggtcatttatctgctttatgtaatgtttggtggactatgtgttgtggtcgctcttcggaaattggatggctgttcaaaatgcacagtgtggtgtctagcattgtttgtagctgagaaaaactactggtttaaaatatactatcgaatacttaccaaataaatagtacttatgaatcagagttataatcaaacataagttcatcaaagtaacaaaaaaagtttaattcagttttttatgttcatttcatcctatttctgttaaaacataataatatgttttaaaaattaattgagaagatgaggtttgtattttgtgttcactctgaggtgcgtagttatttaagtgataatgtgaagttcaatgttacgttaaagtaagcatacaattcttatactgagattatttattggtatcttgctttaaaaatattatattggcctcgtgtattcattttatctcaaataattgaattgtgcatgttttgttgttgaatttcttagggagctctaccgaatattcttaagaataccaaggaagaattctttaagaggataattgatttgcttacggaaacatcagatatttgctatagaggaataaaggatattaaatgcatcacttgtcctcacaagcccgaaggatccatgtttgtgatggtaagatttcctcttaaatcattttatcattagagctgtactagcatcaatttatcacactcaaaaaataattatgctatatttaatttagttggcacctaaaacacttaattcagagtcatgagaaatttttggtgtattgtgttgaagaataatgctataattaggaagttgtagtttgccatgttaacatcaattttcttttgttgctacaacatacttgtcacttaagcttcacttccagtaatcttacattgaaatcctataaacaggtgaaattgaacctatatcttttggagggaatccatgatgatgttgatttttgttgccaacttgcgaaagaagagtcggtgattctttgcccaggtacatctaacatttttgttaataaatggatatgtatgtgcctatttaattaaagaaagttaaaaatttaatattatattattcaattcacttgttatgttcttgtaattctctaacgctataccatgacatataagtgatgctaccttatttagtttctcacaaatctaatgattactttttggctaaacatttatgcttattaattaattttgttatgaaactttgaaaattattctatgattttgttgcttaaaaaaagttaatagttaattacttttagttttgcatctctaatcactaatagataatagtttagttagaatatttaaatatatgtggttatgagttttttattgattgcatgtaaactttttatatgtgatatatgaatatgacgacattattttatttctatatatgaaagaaaatttagcaaagtgatgcaatgatattcagacaggcacattatatccctacctgttgtttttgtcttatggatgaacaaatgaaagatcatctgctttttttataatatttgagaatacaaacggatattgactatctaaaagataaaagttgttttaaaatacaagaaacttatatgtagaaaacattttgcaaaaaccgcaccatccatgagcttggaaagtgtgcttgtaagaatccataatctgtaagaggaaaagaacagggccaatcacatgtaaataaaaattgcgtatgccttaattatatgagaaaatataattcaatgtccaacaatatttgggtacacgtactttgtccttttagtttatggatgttgattactttaagtactgaaggaaaaactaacaaagagatctaatattatgctaccactttaaatattagttaactctgtagtagtaaattaagctagagatttaatataatatcttaaataaagtaaatgttatagccttgttaatgtttctattttacgaataatgtatttatacatatactttacgtatcctaatttaactatgttgcctaaatgcagggagtgtgctgggaatgaagaattgggttcgcattacttttgctattgattcatcttctctcctggatggtcttgagaggatcaaatccttctgccaaaggcacaagaagaaaaaccctttaaattatatctagattgtactaggattggaatgatcagtactaattgtgatgtttgtgctttatacctgttgtcaccaaaatggaactattaatttgctatgaataaagcttacaaattcatatgtgtcaatgaactcatctataaaagttgcacatgtagtttacatagacttgacggttacttctcatcaaggacttttatttacctttgttacattttgaaggcccattatatgttatgggacctctaattagtcttatgatttgccaatggtaacatacttttcttaaaactccaataaataaataaaatattggcatataccacatgaaccagagattaaaataacagcatattggtgaaatagtcccttatatttgccaaattatctcacaaccccacatgtatactctcacttaagccatttattgcaatgatttagtttgtgttgatggcacacaaattaggaatttcggtactttgccattccacaaaattagcatcaattatttgacatcttgggccacatgcttggtctcacatgtctacatttcccaagtagtaaaatgtgccttcgtatttgcaaaacaggaggcactcatagtgcacgcgtgggagctatagtacactggtggagaaactgaaagggtcaattaggcctagagggggggtgaataggctaatttaaaacttaagaaatacggaagcagtaatttttggagctaggctgggaattttcggaacttccgaaaatgcacagagcagcgcacacaaaatgaaaactctagatctataagactataacagggaatacaaggcacaatcagcaactagaccaatagcggcacaagcaagcaaagctagaggagagggatgaagaaatatcaccaagatgtagctcccaaagttgttccctggagttcaaatccttaaggggattctactctctgttgaggaactcactaagagccgggtcttagctaacccttttctcaagaggttgcactaagcactcctcctttcactaagaggtatctcttcccttgcggaggcgagatccggccttcacaaacttctcctggccaaccacaagtagatcggtggctcgggagtgacatctagccgtcta

SEQ ID NO: 786 - DNA, 6047 bp, Oryza sativa; identical to SEQ ID NO: 395

SEQ ID NO: 787 - DNA, 6921 bp, Oryza sativa; identical to SEQ ID NO: 607

SEQ ID NO: 788 - DNA, 8659 bp, Oryza sativa
acgttagtgggtaacccgtgattactaatttactctattatgatctatttacattctaagatacgacaaaagacaaaccagaacataatatgaaaattctgggttaccacttatttgatttataagtggacttgtggatcggtccactttcgtccctatgtgcgatacatcccacgccatccgtggttggcgtccacctgggcgccgcgcggctgcggccggagcccatgcgcccgccacgtacgtgacaccggcgtttgtttgttcgtagaggagaaaatggaaatggtgttgtccagcgcgttgggttccagttcagggccatgatggagtgttcgtttcgttttttttctgatctatagtacgtacattttcggtgacgaagtactactaccatgacgatagtcgtcactccacatgacatgacacaggggaaaaagtcagaaaaagcccatggcaggatggtctcgtcgtgtactactcgtgttgccgtccatccgccgaactaaagcaaaagcgccaaggatcaagtggttattagtagcggttcaatctcttcggacgacctttggaagaaaccgatcaagcggttaacatcgtaaaaagcctgacaacgcagataaatctccctctcaagccgtttggcgtttgcagtgtcagctccaaatcccagcgtaccattgccgtgcaacaaagcaatgaacacctgaacagagcacagcacctatcccacttggtgaaataacatggccaattttataagaccacacgtacatcttcccccgtcacggcaggtcggcaagcacgcagattataacaacgccgcatacatgcagctgcagcaggaggaggacgaggatgcgatgcagctgcagcagctggtcaggtcggtccgcgtcgtaagtcgtaacacgaagcgagagaggggggaaagaagaaagctattcggaactctcctctttaaatgcctaatgcggcatcgctcaccggcctgatccgtgtgatcaagccatcaaaccacacaccacccagcgtcacacgcctgacttcatcatcctcctctcctcctcctccgcgaccttccttccttcccttccccttgtgccgcccccagccaaaattcactcgctcgccgccacacatcgatccacccatccgcccccgcaatcccccacgcggcgcgtcacctaccaccgcatctccacgggcgcggaggttgagggagttggtgagaggagatcagagcagcatcctcggagagcccgcccgccgcccgcattaggattcattaggatttaggactcggtgcttgcattttagcagaagaaatcttgtcaaatcctaatctctttctcgctcgacgaggaggtgaggtgaggtgggagagctagcgaacaaaggcttggtttggtgccatctggcggctccgatggcgtaacccgccgccgccctcagagctcggcctttgcctgccttgcctgccttctgccccgccgccccctgccctctgccgtggcgtggcgaggcccaatgccttttaaaccccgccccgctgccatcctgacgcccccgatccccaccgcctcccaatgccgcacttcccgaacctcccgctcccggaggctgccgccgccgccgcgcacgccgcgctgctcgccctcgccctgctcctgctcctcctccgctccgcgcgcgccctcgcctcgcgctgcgcgtcatgcctcaagaccgccccgcgccgagccgcggcggtcgacggggggctcgccgccgcgtcgtccgtgggcgcgtggtacagggcggcgctggcgtgctgcggctacgccctgctggcgcaggtcgccgccctgagctacgaggtcgcggtggccggttctcatgtcgccgtggaggccctgctgctgcccgcggtgcaggcgctggcgtgggcggcgctcctggcgctcgcgatgcaggcccgggccgtcgggtggggcaggttccccgtactggtgcgcgtctggtgggtggtctccttcgtgctctgtgttggcatcgcgtacgacgataccaggcacctcatgggcgatgatgatgatgatgaggtggactacgctcacatggttgccaacttcgcgtcggcgccggccctcgggttcctctgcttggttggtgtcatgggttccaccggtgttgaattggagttcaccgacgacgacagcagtgttcatgaaccgctcttgctcggtgggcagcggagagacgccgacgaggagcccgggtgcttgcgggtgacgccgtatggcgatgctgggattgttagccttgcaacattatcatggcttagtccgctgctgtcagttggtgcgcagcgaccacttgagctggctgacatacccttgatggcacacaaagaccgtgccaaatcctgctacaaggcgatgagcagtcactatgaacgccagcggatggagcgccccggcagcgaaccatcactggcatgggcaatattgaagtcgttctggcgtgaggcagcgatcaatggtgctttcgcagcggtgaacacaattgtctcctatgttggcccatacctgatcagctactttgtggactacctcagtggcaaaattgaattcccccatgaaggttacatccttgcctctgtattttttgtagcaaagttacttgagacgctcactgctcggcagtggtacttgggcgtggatgtcatggggatccatgtcaagtctgggctgacggccatggtgtacaggaagggccttaggctgtcgaattcctcgcggcagagccacaccagtggtgagattgtgaattacatggcggttgatgtacagcgtgtgggggactatgcatggtactttcatgacatctggatgcttccactgcagatcatcctcgccctcgccatcctgtacaagaatgttggaatcgccatggtttcaacattggtagctactgtattatcaattgctgcctcagttcctgtggcgaagctgcaggagcactaccaagataagcttatggcctcaaaggatgagcgcatgcgcaagacatcagagtgcctgaagaatatgaggattttgaagctccaagcgtgggaggatcgatacaggctgaagttggaagagatgagaaatgtggaatgcaagtggcttcggtgggctctgtattcacaggccgcagttacatttgttttctggagttcaccaatctttgtcgccgtgataacatttgggacttgtatattgcttggtggcgaactcactgctggaggtgttctttctgctttagcaacatttaggatccttcaagaaccacttaggaatttcccagatcttatctctatgattgctcagacgagggtatctttggaccggttgtctcactttcttcaacaagaagaattgccagatgatgcaactataacggttccacatggtagtacagataaggcaatcaatataaatgatgctacattctcttggaacccatcttctccaacccctacactttctggcatcaaccttagtgtggtgaggggtatgcgagtagcagtgtgtggtgtcattggttctggcaaatcaagcttgttgtcttctatactcggcgagatacccaaattgtgtggtcaagtaagtaaatgtatacattattggtgttaaaatgcacggtagttttgttacattttcccctaactcctttccaggtgaggatcagtggatcagcagcatatgtccctcagactgcctggatacagtccggaaacattgaggagaacattctttttggcagtccaatggacaaacagcgttacaagagagttattgaggcttgctccctgaagaaagatcttcagttgctccaatatggagatcagaccatcatcggtgataggggcattaatttgagtgggggtcagaaacaaagagtacagcttgcaagagcactataccaagatgctgatatttatttgctcgatgatcccttcagtgcggttgatgctcatactgggagtgaattatttagggttggtactcattgttgcctattccatctatttcaaaagtttttttttccattgcataacatcccaagcttctgtgttacaggaatatatattgactgcactagcaagcaagaccgtaatttatgtaacccatcaaattgagtttctaccagctgctgacttgatactggtaactacattcttctcacaatctgaatatgttgtaatcatttatgcacaagagtatttccatcagaattaactatacaggcagattctgtataaaagcaagttatttttagttatagttttcatgagactatgcatgatcataggggcctggattgatgtctctttattcttctatattgtgcacgtgcaggttcttaaggatggtcatatcacccaagctggaaaatatgatgatcttctccaagctggcactgatttcaatgctttggtttgtgctcataaggaagctattgagaccatggaattttccgaagattccgatgaggatactgtctcttctgttcctatcaaaagactgacgccaagtgttagcaatatagataatctgaaaaacaaggtgtccaataatgaaaaaccatctagtacgcgtggaataaaagaaaagaagaagaagcctgaagagcgtaagaagaagcggtctgttcaagaggaggagagggagcgaggaagggttagcttacaggtttacttgtcatacatgggagaagcatacaaaggtacactgatacccctcattatcctggcccaaaccatgtttcaagtacttcagattgcgagtaactggtggatggcatgggcaaacccacaaacagaaggagatgcacctaagacagacagtgtggttctcttggttgtttatatgtcccttgcctttgggagttcattgtttgtgtttgtgagaagtcttcttgtggctacatttggtttagcaactgcacagaagctgtttgtaaagatgctaaggtgtgtttttcgagcgccaatgtcattctttgatactacaccatctggtcgaattttgaaccgagtaagttaaatttgttctttctcctgttaatattattttgtatcacttgattcttaaatgtgccatttctaatgtgaatcatgcataccaggtttctgtagatcaaagtgtcgtggaccttgatatagcattcagacttggtggatttgcatcaacaacaattcaactacttggaattgttgctgtcatgagcaaagtcacatggcaagttttgattcttatagttcctatggctgttgcatgcatgtggatgcaggtaattcattgctgaggcagtgaaaactgaatttcttgcttgtgtttaaagaattgagacgtttcacatttctcttcgtaaaaaacattttgcttgcttgcttttgcttactatcagtaatatatgttttctaatcaggggtttttttactgataaatattatctaccacgcagagatattatattgcttcatcaagggaattgactaggatcttaagcgtacagaagtcgccggtgatccatttgtttagtgagtcaattgctggtgctgctacaatcagaggttttggtcaagagaaacgattcatgaaaagaaatctttaccttcttgactgttttgctcggcctctattttccagcctggcagctattgaatggctgtgcctgcgaatggaattgctctcgacctttgtcttcgctttttgcatggcgatactagtgagcttccctcctggcacaattgaaccaagtatgtcttatctggtgtcacatgtactgttctattgcattttgtgatatttctttacctaatcatttacataagcacagaggaaagtcttgcatcattttgtcggtttacattttgctttatctaagtgtggttctatcttgataggtatggctgggcttgctgtcacttatggacttaatttaaatgctcgcatgtcaaggtggatactgagcttctgtaaattagagaatagaatcatctctgttgaacgcatttatcagtattgcaagcttcccagtgaagcaccactcatcattgagaatagccgtccctcatcctcgtggcctgagaatggaaacattgagctggtcgatctcaaggtacaatcctgaactgatgtgtattttatctctgtcctctcctaagccaatcccatttgtgaatttaattctattatcaaacatgacaggtacggtacaaagatgacctgcccttagttctacatggaatcagttgtatatttcccggtggaaaaaagattgggattgtggggcgaactggaagtggtaaatctactcttattcaggcccttttccgcttaattgaacctacaggagggaaagttatcatcgatgacgtcgatatttctagaattggcctgcatgatctgcggtcacggttgagcatcattccccaggaccctacgttgtttgagggtactatcagaatgaatcttgatcctcttgaagaatgtactgatcaggaaatttgggaggtacgccctggtcactttcaatgctgcagccatgttaaatatgtcttgatttttatggaaggacctcttttctttcaggcactagaaaagtgtcagctcggagaggtcattcggtccaaggatgaaaagctggacagtccaggtctgtttctttcttgaataaatggataattcttgtaaagtatggtgtttttcccctctaaatttattttcctgggcgtctgttgggttgcagtactggagaatggagataactggagtgtgggacaacgccagcttattgcattgggtagggccctgctgaaacaggcaaaaattttggtgcttgacgaggcaacagcatcagttgacacagctacggacaatcttattcaaaagattattcgcagtgaattcaaggattgcacggtctgcaccattgcacaccgtatcccgacggttattgatagtgacctagtcctggtgcttagtgatggtacggtctcttcactgaaattaaccaaatgacctaagaattttcctattcacctgtcaaaacttgtccattttacctttcttttgttgtgaacttatcttatcctttggattccaggtaaaattgcagagtttgacacaccccagaggctcttggaggacaagtcctccatgttcatgcagctagtatctgaatactcaactcggtcaagctgtatatagagaggcttagcttaaaatcccccacaccaagtaggaacagggaggtaggatagccacatctgccagtggactcacgccatagaagtaccaacatcatagggcaagacacaagccgaggtgtatatgagcggaaacaaaatgttccctgacgtgaataaaccatggaatcgatgagggaacgcagcgggcagcaccacgggaggagttggtgagattacccgaagctctgatgcttctgaatgtataaacaatgcggtactacttctcccttgcatagtggaaaaagggaaggcaatgttcatgggtaataaaggggtaacaagtttcattttggcaccagattggagtgctttggtctactgtatagaactcacctcacctgtgcagtaaaacataaagcatatagtagttaaaagatgatactgcagcagttcagcgatgaatctgctggtccctgttgcaacttgcaattgtaagagtgtagctgcagaggcaatgaggcattgaagcgaggccatcccagaccatatcgctgcaaatcctttgacagagatagaccatatcgctcgtacgtggcagtcccatttcagcccaactattatggcctacacgggcgtgacagcccgtcccggcccaactaacataggccgcattagttccagcacagataacatgggctgtagaacgggccatcaagtacctgccagaggcaggcgggcccacctcaagcgcgcgcggcagctggactacccgcaggggacggcccccatctcctgatctcctctaccttttcctccacccttccgacaatggcaagtggatccgctaactaaaacgtcaccagtgcaaaacgatcaatcaccaaattcgatctttttaatcggcattactacctctctgtcctatataataaagaaaacaaatataatatgaatatgaaatatccaagtaatacgaatttaacaatatccaagcactatgaatttaacctgtgtttttcatgggactgacggagtacgtgccattgaaaataagaaacttcaaccgttctactgcacatgcctaattattctagcacgaagatgatacgtgcaagaaacgctctgcagacattctaggaaagagaggctcacatggtcagtagcttttgtcgactatgtcggctttagtttatggttcttagaaacagagttatagctgacacaaggtacaaacaggccagatgatcaaacaggacaacataacgtgattacctcttcaaccttcagctttgccagcatttcacctacaaactctatgaactgaaatgccttggcaaagcatatcgatcgttcgatcccaatatcactattacagcacccttagggtacatatctatagagctatctggattctggaacaaattatgaagcata

SEQ ID NO: 789 - DNA, 7639 bp, Oryza sativa
ttggactctctcttcatctagataatcaccttttctttcaaaaaatgggtgcatttttttttcaggaaaatatgtgtaggagataatcacatttccaatccttgtctcaactctcatcctcttttcctttttccaaaggcaaaaaacacattcatctttcccccgttcttgtcaaagagagatgattcaaatcgtagctaatttcagtttgcctcaatctcaagctgatcaggcatattctctaaaatgtaccaatgtaccattcctacatggttgcctctctactttctttctttgacttgtggcacacacctctatacaacatacgttaggggtactatgtatgcatggcaagtgagaaaatttcccaattaatggcattgttggctacttattaaatatcatagctgggatgcatgactaaataggtccatgttgtgtataagagactccaggttaggccgcttggatgatgcaatttcccccctgttatttaagcaagcattatatcgctttaatgcaccattgacttaaaaatgcaaaggagacaattcttttttttattgcttgccatagtgaattttagagtggcccacgtgtcatcgacaataaataagacataccacgtccgtcaaaaagacattatttataactacgcacgtgggcaagtacttatctagattcaatcagaaataaagtctatatgaacagagggtagtaagacaaatatttctatggatcaaaattgatgctcctataaaaaaaattactggtgctgttactaattgggtaacataacatacacatgagtccatgaaatgaattgctgtgatatatgtcaaagtgaaagtggtgaaatgcctcttgtgtcacaggtgatggtggtatcaaatccaaggattccccatccatggggaaaatggccaagtttatatgtgcctttgcctcattattgaacacccaccccccaccctacccccctttgtgtcacctttgattctcccctcctccaagttgcatctcacttttcctccttccccctaagctcacactagccctcttatatacacaccccaaaccctcctagctctccttgcaacaacaactaagttgttggatagtaaaacctagctttgctatagcaacaacaacaacaacaaaaaatctctctcacatggtggggatgcgtggagcttatggctacaatgacaacggcaacgagggtggcgtagtagttggagggggggaggcggaggcggagatcgcggcgatggcggtgctacacaaggtggcggcgccgccggcgcagagcacggcgagcaagctgaaggcgagggtgaaggagaccttcttccccgacgacccgttccgcgggttcaaggggaagccgctgacgaccaagtgggtcatggcggtgcagtacctgttcccgatcctcgactgggtgcccagctactccttctccctcttcaaatccgacctcgtcgccggcctcaccatcgccagcctcgccatccctcaggcaatgatataatcttcgccttgattcctttccgtttcctgtgcatgcactccatgtgttcgacgaaacagctagctgcatcatatcgatccttgcgtgtgaatgtttgtctttgatttttcttttcctttttttttttggaagtttgtaggatcattttggtaacatcctggtcatgtacagatacacaccaactgtactccttaattactggctttgcatgtacagcgtgatttttaaccagcattcatggttgctgattaactcgatcttgcagggcattagctacgcgaagctggcgagcttgcctccgatcatcggcctctgtacgtgctagcttgttcacacgctttctttctttccttccatgcatgcgtgtgcatgcaaatatctttgattattagtaaatggacaatggttaggtgattagctagtggtaattaactaattattgatggttattgtgtagattcgagctttgtgccgccgatggtgtacgcggtgctggggagctcgagggacctggcggtggggccggtgtcgatcgcgtcgctgataatggggtccatgctgcggcaggcggtgagccccgccgccgagccgctgctcttcctccagctcgccttcacctccaccttcttcgccggcctcgtccaggcctccctcggcatcctccggtgatccatccatccatccatccatggctagctgcatgttcctgctcattgatgccgaattgaagcatggttgcatgatgtgatctcatcttgatggatggatgcaggctggggttcatcatcgatttcctgtcgaaggcgacgcttgtcgggttcatggccggcgcggcgatcatcgtgtcgctgcagcagctcaaggcgctgctcggcatcgtccacttcaccaccgagatgggcctcgtccccgtcatggcctccgtcatccaccacaccaaggaggtaactaatgatgtcgcaattgcgcatccataacgtcgccggcgccgccgccgccgccgcgacggcgagctaagtgactgtatgactgaccaatcgatcgatcgatcaccgtgctttgtgcagtggtcgtggcagacgatcctgatggccgtgtgcttcctggtgctcctgctcacggcgaggcatgtggtacgtatcacatcacactacacacgcgtctactccttttgactgccgttgactgatgtctacgtcatgttattctctgattattactattattgttatttgtttttgcaatatttcttccttcgaaaaagaataaatgttcagctagctagccactgatgacacgcatgtgtggtgctgatcatagcaggggctatattagcggcggttttggcgtttctcttggacatgtttcgattcgcttcgtctgtagtacgcaggatatatatatagcttcgtatatatgttgtcgctatcgataatcatgcagccgggtgaagtcaggcatgaaatgatgcatatatatggccgacgatccatcctttggaaggatgtgcgtgcctttcttgatcaatttggtcacggacatggatctctctctgcaggttgttgcatgcatgtatgggtccatgtctagctagtctttttattttgacagtccaagctaagtacagtattttagtaattaccagcaacttgttgcagtaaaagtaacatgtcaaaagtcattagaaaattactggacttaattatttggtcaaaggaaatgtagtattaatgttcgtttgggctgcgcctttttcagatggttcatttgttctgttttttgaaaaaaaaaattatatttgttctgttggtgcatgcacacaattcagtattctgaaccttgcaaccatgctgatagagaacactactgctagttacgttgaagatagtgagtattaggtggtggtggttgcagaacactattgcgaaagggcacgaatagtagttgcagtgaccttagtagcactctaaggtcctgagtttaatcctctataggaacgaatttcagattaagttatttgaggtgttaagttttcaatttaaaaaagctacatatatccggttggatataaaggttgggtaaaaaatactctttaaaaaaaggtggtggtggtggccagcactcgtcatacatacatatgcccccaataatcaactcaagcattgtttagttcccaactttttattcaaacttccaactttttcatcgcatcaaaactttcctactcacaccaacttccaacttttttgttcaaacttccaatttcagtcaaactttcaattttgatgcggaactaaccacagcctcagcatgcacggttttttttgaaagaatgtaagcctgtaaggctgtaactagcaaattaaacagtccgtaggttctgactggaaggctacaaatggagcagcccaagacgaaataatgcaaccgacactgatctatgctactagctccagaggaatagtgttgggcctctcaaggccacatggccacattggttttgaccctggaagaactgaacagatcttgcaggtagtacataagggaggaaaagggacgaaatttacacgatccaacatccctctcctgaaaacctacagtctctgtctctctgatatgtgatatctgcccagtgctctgtagactgtacttctttattctgctatatttctcgggccatggagttattctcccaaaaaacagatgtagtgttcaatattctgaaaatgaggatggtggtagtatcagtgaaaagttcatttcagaaactgaaatcaagtacattttatttttgcactcgttaattctaactcctgcacaaattctatcttctgtgtatgcagagtatgaaatggccaaagcttttctgggtttcagcttgtgctcccttggcatgtgttatcgtctctaccctgcttgttttcctgttcaaagctcagaaacatggcattagcatagtaagaaacctgaaacaactgtaaattactgcattagtattttcttagttgtaacatattaataaaaaaatgcctatcttttccctgcagattgggcagctcaaatgtggcctgaatcgcccttcatgggataaactactctttgatcctcaatatttgggcctcactgtaaagactggccttgtcaccggaatcatctccctaacggtatgtctgtcataaattttaccattttaactgtgtttttccatgggaaaattaatgtatcccatgatgctatctgaacttgacaccccatatatgttcagaatcttgtgccatagtatcagtactattcagataacacttttcactatttaccaggaaggagtggcagttggtaggacatttgcttcactcaaggactaccaggtagatggtaacaaagagatgatggccataggattgatgaacattgtgggctcatgtacatcatgctatgtaactacaggtacatccctgaaccaatctttaatcctagtttcatcaccattcacaaggatagaaagaatgatttccgttcaaaaaaaaaaaggatagaaaggatgatggtctctcttatttaatttccatcaggagcattctctcgttctgctgtgaaccacaatgctggttgcaagactgccatgtcaaatgtgatcatggcactgactgtcatggtcacactgttgttcctcatgccactgtttgtgtacacaccgaatgttgttcttggagcaatcataattgctgctgtgattgggctcattgatctccctgctgtatacaacatctggaagatggacaagatggatttccttgtgtgtctatgtgcatttgctggtgtaatcttcatctcagtccaacaaggccttgcaatagcggtaaccaataaaactgacaaagctaattattccatagagtaagttgcagctttacttgcttactgattaaaattctcaaattttgcaggttggtatatcaatattcagggtactgttgcaaatcacaaggccaaagatgatgattcaagggaacatcaaaggcactgatatttaccgaaatcttcatcagtacaaggacgctcaaagagttcctgggttcttaatcctgacagttgaggctcctataaactttgcaaacaccaactacctaaatgaaaggtaaaacgcacttctaggaaaagaaataaatactagaaatcaaagttctgaaaagtggataaatatatctgcaatgtttctgtttgtaggattaaaagatggatagaagaagaaagttctgcaggaaccaaacaaagtgaactccatttcgtaattttggatctgtcaggtttgttacttcgaatgaaactttcatccactttattttgttagtatgttcctttcaaatgcaagatcaggtcataccagagtctagtacaaaggcttctcagctgtactaacacatcataaaactatccttctcagctgtccctgcaattgatacaagtggcatatcgttcctcatcgacttgaagaaatcaacagagaagcatggactagaggtatatactctaatttcctaaaacataaacacagttttggggcacaaacaaaacccccttcttcttcttaatgaaatttggtcgaccgaatccttcggctgacccggcaaaaaaaaaaaagttatgtggcatagtaaaccccctttattttatttttgcagcttatacttgtgaatccaactggagaggtcatggagaagatacaacgagcgaatgatgctcatggtcatttcaaatcagatagtctgtacttaaccactggggaagcagtggcttcactctctacattttccaagatgacagcgccttagagctgattctaaggttgtcattttcattattattctaactgcgctgctaagtttgcaatgcaagattttccaccctgttctctcagcaatagaagtgcctccagcaacgtatttcccggttatgtttgtacccccaatcttccgaggtattcagactatgtgatgcaaacttggcagtagaagtactgagaatatgtaccttgtgcatacccatcagtatttgtctacatgagggcaaacacaccaacagtacagaatatatagtaattctcacatgaaggttgcattggagtgtttaggactagaagttctaaactaaaaactactacaactaaatccaataattaacagctgaaaaacagtcgattctacatcatccatggcataactaaaacaactgaatgtgcactcgtgaggcagaggcctcaatccgggcccgtacctacatagatgggccggaatttcagttttgacttccaggcccatctactggaaatgggccataattgtggtgggctgccaaacaaggcccacatttgggcgcgaaattccccccttttccccccttcttccccagcgaggctgcgacggcggcaacgagcattaaacgcggtcgacggccgttagcgaggtttccgttcccctttcgttcatccgcctcctcgtcgtcgtcgtcgtcgtcgtcgtcgcccagcgcattgcccgtcgccgccatggcggcgagaggcagcaagaaacgcaagctagccgaggaggacccgggcatcatcggagcagggcggccgccgtctcctccatccgggtctcgtggctcggctgaccggcgcctgggggtggtggtggtggcagatccggattccgatcaggggtcgtgcgactcgctgctgtcggacgccaccacgaggcttacccaagacgacgcagccgaggctgcttcgcggctcctcatcgccgtcgtcgtcaggtcgcccgaagccctcctcgcgttcgtccagcgactcactccggaagcagtgttccgcgccatcgattgggacctcgtcccgtctggcgaggcaaggaaggtactccgtccgatttatattataaatcgcttcgatttctttatcagtcatttttctttttaagtttgatcaaatttatatgaaaaataatatttccaatacaaattaaatttattatatcaatgctacatccaataaaactaatttgatgttgtagatattgcaaaatttttctttaaatttagtcaaacctaaataaatttgagtag

SEQ ID NO: 790 - DNA, 6047 bp, Oryza sativa; identical to SEQ ID NO: 395

SEQ ID NO: 791 - DNA, 17518 bp, Oryza sativa
actaatttgtagtaaagaaaagaaacatcaatcttatatattttcttgtcatattttcatgtgtaatctttccacccaccctaaaatcattattaaaactcctgctctatcgatacataagggcaaagctcttgccttttcttccaaaaacaatgtattttctccctaaaaatgtgaaaatacaaataaaatactacaacaaaggcccactcaacgtacacatttaagaagaaaacccactgcccacataaaatccccgcttgctagttcttttttttttaagatagtacatatttaagaagaaagaacgataagcgggcaaaaaaaaatcttgcttgcccacaccggttgcatctctatacctctccccgtcttataaaaaacaaatcgagtatgtaatacaccatatctaggtagtattaggatgtggtatactctttccgtcccaaaataagtacagttttgcactgtttatatccaacgtttgaccgtttatcttatttgaaaattttgtatgtttactacttttattgttattaaatgataaaacatgaatagtactttatgtgtgactatttttttaattttttttataaatattttaaataagacggacgatcaaacgttggacacggattatcatggctacacttaatttgagacggaggtagtatttcatattagatctatttatttttgaataaagagagtacatattatgatactggactactggagcaatacccagggccagcaacaaaagaaaaaaaataggagcatccataatgaaggagtacaaggctaaacaagtcaagtccgttgcaaaaccccgtcaaaaatcccagccacgggccaccaatgcgccccagtccgggccccaccaaaagcccccaaaaggcaatcaaatcagttcaatccaactacaactccgccttcaaaaaaaaccacacaaacccaaccgcgagtccgccgctccccacctcctcgctctcccacccattcggcgcccccctcgctcggcgccgttcctcccctctcgcctctcgcctctcgccctcgcctgcgactctccgtgcgcccgagaggcatccgcatccggcatcctcctctcgtcgtcgtcttcctcgtcgtccgtaaccacccgcgcgcccgctactccacacgcacccatccatccatccctctccctcccccccgccctatcctctcctctccccctcctctccacacgatccacgccttgtcgccttcccgcatccaccaccaccgcctcccgcgcgcccgtcgttggagatatatcacgcgcggaagcgcagccgcgtgtattgtttgttcgttcgttgttgggtggtggtagacgaggggtggtggtgtggtctcgtgccggggaccggatcggcgcgcccatggccacgctcccacgtgcggcggcggcggcggcgccgtcgccagccgcggcgctgctcccgctcccgcgcgccgcgccgctgctggcggggcgcgcggcggcgcgctccgcggcgcggaggctcagggcgagggggacaagggcgccgccgctcgcggccgcgcggcgcgggtggggaggcgtctccccgcgcgcggtgctcgacctgccacgacgacgggaggccgcggagaagcccgcgcagaaggtatgggccgctccgccgatcaggcgcttgtacagtggtgcggatggttgggtgagagatggcgcttggatgggtcggtgttttggggttttgcatgtttggttgtggtgattactgattagattggtttatgaagctatgagcccatacgtgttttcatggattcatccctagttttgaggccattttggtttatttttctctctatacatgcttctagtggatttgcggtcgccccgaatacattggaaatcagagtaagctgcggtagaggtggttcatggaactgatgattcagattatttaacgcctcctgatcactgttattggataggcttttgtcctgatgcaaaagctacttgcatgtgcaagctttttttaatctctagttgatccttgttcactgcaagttgtcgctgttgcgctgttccttttgtggatttttttaaaacagtagggtagtaagtgaacaaactacaacaaatgcaggtgcgataaacaattatttggtaaggaacggatacatgacagctgtggtggtaggtactgatcgcgatcgaattccaggagtaccacattgtgtaatgcattggtgaaaaaggctgtaatgtactttccatggctcttctggaatgtcttgaatgcaagattgtattctgagtcgcaattatgatgctgtaaatcaagcagtgtgttttgctcttgttgatatcagtatttcctttctatttatcaggctgcagatttgaatgaaatcttatcagaacgtggtgcttgtggtgttggatttgtcgcaaacttgaaaaatgagccttcattcaatattgtccgggatgcccttgtggctcttggctgcatggagcaccgtggtgggtgtggagcggacaatgactccggtgacggttcaggactgatgagtggtatcccatgggacttgttcaatgactgggccaacaagcaagggcttgctcccctggacagaacaaatacaggtgtcggaatggtctttcttccacaagacgagaattctatggaagaagccaaagctggtagagtgtttcttatgcttacctcaattttctgcccacattaccgagcatttcttgctttcaaagtgcaatatttcctgtgttcgtatggatcataacatttatgttcgcaatgcatatcttgttgccacctgtttcggtatgttttatttgggagttttcatgctgccatacttcatatcccatgacaccttgacccttttctgactcactattatcccttgcatgaaattttagaaagtaaatatcatttatttgtatctacaactataacctataacaaatgcattttcagtttcttgtgtgctaaaattttcatcccttcaaagggacaattattttataaaactcacaatgacatctgcttcacaagtgaaaatggatatggtggttaagtaccatatcctgttttctattttttttttaaaaaaatacattcttatggttggtagccagcagttaccatgttggtttcgtaccattgtcatgcatgatctgaatgtcaccatgttgccttttcagttgttgccaaggtattcactgacgaaggccttgaggttcttggctggagaactgttccttttaatgtatcagtggtaggtcgctatgcaaaagaaaccatgcctaatatacaacagatatttgtgaaagttgcaaaagaagataatgctgatgacatagagagagagttgtacatctgccggaagctgatagagcgggccacaaaatctgctagttgggcagatgaactttatttctgttctttgtcaagcagaactatagtctacaaggggatgcttcgatctgagattcttgggcaattctatttggaccttcagaatgaactctacaaatcaccttttgccatataccatcgaagatacagtaccaatacaagccctagatggcctcttgctcaacctatgaggttacttggacacaatggagagattaatacaatacaggtttgttcctgaatctataattcttctatttgttcgctgtatctgatgtttagcaaaagtgtgttattgaagattaaacatacctcaagtgtattcatagtctatcctttccttgcaggggaacttgaactggatgcgatcaagggaagccacactacaatctcctgtatggcgtgggcgtgagcatgaaatacgtccatttggtgatcctaaagcatctgattcagcaaaccttgacagtactgctgaagtaagagactgcacatggagcatccattacttatgcttcttgtccacacaattaacataattttgctttcttttttgtaataattctagagccagttttttggggcactccttgaccgttcaaaattcctttggtgaatttgcttaacaacacataatttgtctagcagctgtaggatgttaacattttgataacaattgagaagtaaaatacagaaatctgacgaaaaaggccagttcaaagtttttgaaacaattgaaagatgcacagcatgtacaaacatcctatgatactttgaattaatgcttttgagatgtggagaatgaagttgtacttctaaatgttataaagttgcaagttactgctagttgctaagcaacatgatttttactcgatctatttcaatgtgcattatcatttatatatattaatctgaatgtgcatcacacaccctgctctcttcttcaatgcattaaaagttgttgcaaaactgctgttattattaaatcatcaaattctttcttgcaccagttactgctaagaagtggcagaagtcctgctgaagctatgatgattctcgttcctgaggcatacaagaaccatcctacattgtcaataaaatatcctgaggtatggaatgcgttagtatatatagaagccatgggtatgcatcaaattcctcacatattaactagtgcaagcagttctgttcaagtgaatgttctcttcatttgtgcattaggtaatcgacttctatgactactataaaggtcaaatggaggcttgggatggacctgctttgctcttatttaggtaaaatcatttttgtgttaatctgttaggtatttaatttattttcttttgctatgtcagttcatgatgtgtaggcacagttttcttgcacagtttggtcaaaggcatctcatgcatcagcagatttgacttccttctaatttatataccttgattcaagaaataaggatgcaccaagtagctatttattgtgaaagataaaatcataagagaaggctacatgctgtcattagaagtattggcaaacgatatctaagtgtagctgtagaaacctattgaagcatggtacagcaataaaattccatataggagacaaaactgatatatgcaaaataacaacatatattaaaataataatgaaatattgctgaactgaaatattgctgaactagtccccatgatagaggatgctttctgttttcatgaataagatattccaatacttctccaatttagagcatcctgcaacagaattgacactgcttacaagttcgatttggtatattcttgcgtgcagtgatggaaggacagtaggagcatgtcttgatcgaaatggtctccgcccagcacgctattggagaacatctgatgattttgtttatgttgcatctgaggtatgcccttttgatgttctggtaattttattcttctgtatagaattgattgttcggtgacaatgttattagagagaaacattgatattctcatgtatagtgaaatctccattttgaaattcttgaattggagcatttggtttatctgccaataacttattgcagatatactgacacccttctataccaaaccgcagagttcagatatcattgagtaagtattgtgtccatttgctaaagtgtaggtctgacatctacaacaggtgattaggagaaaattacgaagttagtgttttcgttcctattaggatgttatgttttatgcccatgcatgtgtggtatcatcctataatgataccacatggcaattaagttggcagagtaaatgcacagtacctcaattgtagtgaagtaaatagcatttgcagggtacatggatgccatgctattcttcctttcctctgtcttaaagaagcttccctcacaccttccttataccggcagctttttatatagtattgcatacaccattgagcatttaattacggcttactggatgcataatttgaagaattggtttacgtagatgatcactgctgctcttgatagacgagttgcttcatgaaattgttaagtcaacttatgcttaagtttgctaagtccaaatcatgttcgactctttggatggcaattcatactctattaccctattttttactatcttttgagcagttgaaatgcgatatattatatttaaaatcatgacaataaaatattaaccttgtgccaccatactgcaacacttgatggagttactttggatcactttcttaaatgccctgtgggagtccccaaagttctatattgtatggttcttactgatcactagcttttttttttatgacaatctacaggttggtgttataccaatggatgagtcaaaggtagtaatgaaaggaagattgggtcctggaatgatgataacggttgacctacaaactggccaggttagaatagaaatgaaataaccattttcctttcttgctttgagtattccagacaattcaaatatatgtgctaaacctcatgaatcatcttaggtgcttgaaaacacagaagtgaagaaaagtgtggcttcagcgaacccctatggatcctggttgcagcaaagtacacgttcaataaagcctgtcaacttccagtcatctgttgctatggacaatgaaacggtcttgagacaccagcagtaagaatccctcagactttgttccatcgatcttgaacatctgttctttcttttccttcaattgggaactcccctactgttctcctaaacaatcatctcttttgttcttttctccttgtggaacctaagtatgtttgtgcttgagatagcaagtctatgtgctgattgtacatttgtacctggtatttgtgttgaaaaatatttgtgtaactttacatatataaattaaattccttgtattgcaatgtagttttactcttcctgatggacaaatgtagtctacagctgattatatcattatctaacttaattgttcctttccattatctatgcccaatgcgatagagaaatagaatgtagcgtctttagtttttctattttctagttgtacatatcccaataaaaaaaaagaaaaactcccatttcaaaataaaattgtatcagaatgcgccagtaatttttttaatgaaacaccagtaaacctaaactaaccattaatacaaagattatattggcaggccatccattttttgtagtgttatatcttgtgaaatatcacaatagcaactaaatatggtgaaggtgtaaattgtgaaacatctcaatttctgaatacaccagaagaagtaagattcattcagatttcagaggatatgcccaaaactttgcttttgatcttggtaaaacgccatgcctagaaatattcttttcaaccaatttggctgattttggtatgttctcgatgtgtactactccgcacttacctatttttctgtagatcagagtatcaggcgttgctgcacagaaaatttgatgagacataaagcttatatatgctagatggtcattcaggcttgatatttaatttgagattactgtctttgtcttcagggcctttggatattcgagtgaagatgttcaaatggtaattgaaacaatggcttcacaaggcaaggaaccaacattttgtatgggtgacgacattccattagctgtgttgtcacaaaagccacacatgttatttgattatttcaaacagcgatttgcacaagtaagtaaatccttgctgatattatgccagacaacttgttaaacacctaaagtgcttttctcattgtttaatagtgtgtatttctttgtgcaactggtgtttcaactgttagtgatgcacaacaatggcctgttgtccattgatttttttcctcatttacaaaagtaattatagcaagatgaaatcctgccttctgctggacataataatgcattttgtccgatttgtaggttacaaatcctgctattgatcccctcagagaaggtttggttatgtctcttgaagtcaatattggtaaacggcgcaatatcttggaagttggccctgaaaatgctgatcaggtagttcttttgaaggaaatagttttttttttttttttttgaattcatggggaatataaagacaccatcttgttgaattttcaggttaccctatcaagtcctgtgcttaatgaaggtgaactagaatcacttttgaatgactcaaaactgaagcctaaagtactctcgacatacttcgacatccgtaaaggtctagatggttcccttgataaggctattaaggttctttgtgatgaagctgatgctgctgtgcggaatggttctcaacttcttgtgctttctgatcgttctgaagcactcgtgagtagcttctgagttctgacattttaaaatcctacttcctctgtttcaggttataagactttctagcattgcccacattcatatagatgttaatgaatctagtcaaatatatatgtctagattcattaacatctttatgaatgtgggcaatgctagaaagtcttataacctgaaacggaggtagtagcatttaacgtaaaagctgtgctattttcatagtcttggatggctaagacatctttacatttttatttcactcctttacataaccaacagattgagtgtgttttatttctttattcaaatgtttattactccgtagtggataatattaaccaattatccttatttgaactctaataataattataattattataaacacttacatccatggtgcaatgatactctgacgaggccacataattggtacctcggtagtatcgattagttacattttatatgttacctgcccagttatatgtctgtcaggagcattacttactatcacagtttagatttatagaattttgtaatgatgactactgcagtactgatgtatccacagatgcacataagtttgtagcatgaaagcttcatgaccgaatgctaatctacctagtttttttttctcttccatgtttagatcaaaatgcaaaggtttttttattcaaattcggactatttactagtacaatgagatatacagttgagataggattgtgctatttgctttattcatgtttcctagattgcaatattaaattgcttaatgatgtaggaaccaactcgccctgccatcccgatacttctagctgttggtgccatccaccagcatttgattcaaaatggtcttcggatgtctgcttccattgttgctgatactgctcagtgttttagcacccatcagtttgcttgcttgatcggatatggtgccaggtatgactttattgtcaacatagatttctttcaatatccaccagttcattacttatatttgcttcattttgcatccgaatcctgcttagatgaatgcatacactctgaattaacatatgaatgggattggaatttagcattgtgcttaacacaagaagccgtaatataacacaactaagatacaagagatccattaaactaggtgtgttcttccttttcactcaattgattttgtgtaggttgtagtcataggtgtgcacttcctctaggaaccagatagtcttaacagtgctgcatctgcttttagatttacttgtattaattcttgttttgtgcattagtgctatatgtccgtatctggcactagaaacatgccggcaatggaggctgagcaacaaaactgttaatttgatgcgaaacgggaagatgcccacggtgaccattgagcaggcccaaagaaactttatcaaggtatgatttctatagcttgagttgtgactagtttgttgcatgctgttatactgttgccactctgttaatgtactcgagtctgatactgcattttactttttatgatccatcatctcatgttaaaggtctctgatttgtgaatgagttatcccgtatcacttgtaagcttgtagttagtacttcatatgtcattttacattttttattaattaatatatattttttcaggcagtaaaatctggcctactcaagattctttcaaaaatgggaatatcattgctctcaaggtttgtttatattccctcatacagtgtgacagaattatggttccaatcttgtgaagtttgaactacctctgcaatatctttacgtatcctcttttttttggacagttattgtggagcccagatcttcgaaatttatggccttggtcaagaggttgttgatctcgccttctgtggaagtgtatcgaaaattggaggtctcacccttgatgaggtattttacaatttttcagtacgctacttcaagtcacttgaacgccattcacaattctcaattcctacatggttttattttttttctttgtctcacatagtatttaattgtctgacgatctcctattcgtgtactatttatctcttttttattgttacctgctaacacttctctgacaccacaacccctatccttttctttgcaaagctgggtagagaaacattatcattctgggtgaaggcgttctcagaagatactgcgaagaggctagagaactttggattcattcaatccagacctggaggtagcatctaactcatgaattgccacgaacacccctgtttgttgccatttgctcaatcaaaatgacatcaattcgatgatctgagatctagttttgtacagaatgtgtttttcgttttatatctgacactatactaaggcactgtgattcagaatctaagtttggttgggtccctctagggattcaccaataaaaaaaatgttttcatgcatcctctcctgtcaagtgccatggtactatttattgatgtcttctggttctagaaattcttttattctattgtaaaggatataccagtaatatccctgcatgaattttgtgggatggagttttgggctgcacaggcatgtgatcctggatttgatccacacctacgcccgtgtaagggtgaaagttgaaacacctttttctaaaacaaagaggcaacagtagatgcttacaaaacatggctttatagtttcaatagaacggacaatactctgaagttttcctataagattccctaaagttgatgcttagagatttgtttttatgtaagaaatttcaagtttatcatcttatgtactcatgtgcattattatttaatactgaaactttgttgcttttatattttctgaacaggtgaatatcatgcaaataatcctgagatgtcaaagctgctgcacaaagcagttcgtgaaaaaagtgacaatgcatacaccgtctaccaacaacatcttgcaagccgtcctgtcaatgttagtgatgcttactccttactttgcagttggccaatccacagatccttttggtgttgcatttggttcaccactatatcttttacactgcaggttcttcgagatcttctagagttgaagagtgatcgtgcccctattcctatcggtaaagttgagcctgcaacctccatcgttgagcgattttgtacaggtggaatgtcccttggagctatttccagagaaacacatgaagctattgcaattgcaatgaatagaataggtgggaaatctaactccggagaaggtggtgaggtgtgtcagataattttccctgagatgaagatatatacttaattatgtcaaacagatcaagtggaaactacaagagaaaattgcttatggacttctctcttttcaggacccaatccgctggagtccccttgcagatgtagaggatgggtattctccaacacttcctcatctcaagggtctacagaatggagacactgccacaagtgccattaagcaggtgcagcatcagaatttcatgggtgctatctgcattacttaattgtcattatctgtgtgttttttctcaaattttccttgggcattattataatattctggatggaagataacattctattttcaaaaccattacttgtgttggaatatgagcatgtttaacttttgccaaattgtccttataatgtgtcctctatgtcacaaaaaataaagatacagagcatgcttaactaatttcattctatatattagtgcagattaactatttcatcctttacttactagagtagtccttaatcaagagtacataacgtccattttctagtgtattagtatctttgagttagttttcacttataccatcctcttacaggttgcatctggacgctttggggttacaccaacatttttagtaaatgctgaacaaattgagataaagattgcacaaggggcaaagcctggtgaagggggccaacttccagggaaaaaagtcagtgcatacattgctcggctgagaaactccaaacctggagttcctctcatatccccaccaccccaccatgacatctattcaatcgaggatctagcacagttaatttatgatcttcatcaggtttgtcttctcttagtattggtgcaatgagccaatgacaactagaaatattgttggtgctgtgggagaattacataagctttagaataaaagtttgttgtagcttgcaagaattggagcacttttgttacctttacctactgttgacatttgaagtagagttggtgcattccctggcacttaccaagacatttttttttcaatatctggtgggagcagatcaatccaaaagcgaaggtatctgtaaagcttgtagctgaagcaggaattggaactgtagcttctggagtatccaaaggaaacgcagacataattcaggttggttaaacttttctgtgttaattattcagagttaactcttgccatggtttactgctattcaactattatttttgtaccattaactcttagctgcaatgctatccctctatcaggtcgcatatggttttgtttgctatcttatgctacatattttgtcatttatatatggtattcacaatgataggactctcttctgtagtttgtttttctctatattgagaaatattgattcctttactaaagtggcatatgcctcaacactgagtacttgctaatgaatgccactatctagtgaaaaatgtgcccaagaagctgttatagatcgtggaggattctttgagaaatttactaaaatgatcccaaaatctcagcagtgtggtgcatgatgctctcttcaaaaaatacccatactaatgaagatactgaacatatgtacaaattgaatgaatgtactacctccgtcccaaaaatctcttatattttgggatggaggtagtactaaactatataaccttttgcttcaacgcagatagattattgcaacatttgaattagattatttatgaaaacttatttgaaatacgtgtatttctgtcacacagatatcaggtcatgatggtggcactggagctagcccaattagttcaatcaagcatgctgggggtccttgggaacttggtctttcagaaacgcaccaggtttgcttcatctatttgcttcttttacctattgaaacatcgtctttgttctaatgctagttagcttgtctccagacacttatacaaaatggattgagagagagggtagtacttagggtggatggtggattcagaagtggcctagatgtccttatggctgctgccatgggcgcggatgaatatggttttggttctgtggctatgatagctactggatgtgtcatggcacgcatttgccacacaaacaattgcccagttggagttgctagtcaggtaatggcaatagaagctattttttttccttcctcttttgagtttctatctttacaccttaaaagatcgacctacactggtattttatcctacattccatgtacctgcagagagaagaacttcgtgctaggtttcctggtgttcctggtgatcttgtaaactacttcctctttgttgcagaagaggtatggcatcattcacattactattgctatctgtattaatcttgttctgtagcaattatggtcatgtgatatatcttattttgcacatatcagcgtatttcatactcatgcttaaattatccaggtacgagcgacattggcccaattgggttttgaaaagctcgatgatataattgggcgaacagatatacttaaagcaaagcatgtctctttggcgaaaacacagcacattgacctcaaatacctcttatcggtacagagttaactgccagttttgttttagtagttggcatttcaaccatatgcttgttatagtaatcaatctcattgtaccagagtgctggattacccaaatggagtagctctcagataaggagtcaagatgtccacagtaatggccctgttcttgacgagacaatccttgccgatcctgatgtaatgttttctattcggttctcagttacattaacttcactagtgactgatttgtgaatagtcagccaaagtaatccttgactctgctacttggtcagcttgaaaccaggacgaacgatgtccttaattgtagtttaaagctaactgtttagttgtatcttgcttaatggtgcagcattacttatatatattctattttgcagatatccgatgcgattgagaatgagaaggaggtttccaagacatttcaaatttacaatgttgacagggctgtctgtggtcgagtagcaggtgtcattgccaagaagtatggtgacacaggatttgcaggccagctcaacattacgtatgttaaccgttttctttttttttttaattcgatttctcttatgaaaaggtaggaacataatgattttttgcccttcaggtttactggaagcgcagggcagtcctttggatgtttcctaactcctggaatgaatattcggctagttggagaggccaacgattatgtgggaaaggtatctaatgcaaacaggcatgcagcgctattgaaaattgtgcctgaccagatttataataccttttctttttttaaaaaaaatgcagggtatggctggtggagagctggttgtagttcctgtagaaaaaacaggatttgttcctgaggatgctgctatagttggtaacacttgtctgtatggagctactggtggtcaggtatttgtgagaggcaaaacaggtgaaagatttgcagttagaaactcccttggtcaagcagtggttgagggcactggagatcattgctgcgagtacatgactggtggctgtgtagttgtacttggcaagtaagtaccacatgcaggattctcatattgagaatcgccttcttttgtcctgatatatggatatttctcaatcgacagagttgggaggaatgttgcagctggaatgacgggtggccttgcctatattctagatgaggatgatacactcgtcccaaaggtttcataaccttgaaacttctggttttactagcttgataacatgcacgtatatacgccagttaggacttgttctttttaatatcattttccatatttctgtctagttgcatgctcggcttaggacaacctcagactaacatgttttacatgattctacgtcgtcaggccttttatctaaaaaaacatgattctacgcaagtacagggaatgatgattagaaaggcctacatgttctgatataatattacaatcttatcatctctaataactttcgttgcctatttcatcactttgcatgagtaaattgttcatgtatgaaggtcattgtcaaggtaaagaattgacaattagttgtgtttccttaggttaacaaggagattgtgaagatgcagagagtgaatgctccagccgggcagatgcagctgaagggcttgattgaggcttacgttgtaagtgaagttcacttcggaaagtttagcaccgactactcgttcatttcccatttcgctaacactgaacgttgcttttacaggaaaaaacaggcagcgagaaaggtgccacgattttgagagaatgggaggcatatctgccactcttctggcaactggtaccaccaagtgaagaagactctcctgaagcttgtgccgagtttgaacgagtacttgccaagcaagcaacaacagtacaatcggcgaagtgatctactgcaattcccaagtgatcagattagacaacaggaaggtgttctttggtactttccaggtgattttttcctgggaccgcatcaaggaaaacaaaataacaactggcatacttgtgaagcaccgaagtgcccccaaagactgcgattttgtggaagctctgcccaaggcatcttttgaaacgaagtttcacatgatcgtggaggattcttctttgcgcccttgcacttgcacgccctagttaaccacccccctgtaaattggtttgctgacgctaggttgctatttgcagaggcagtgaagacacacttctaaacttctccattcctgtacaggattcgtgtcctatgtaatcgtatttttggttctggacacattagttcttacatttatacccgtccagtgggggcatgcgagtcgcatgtgcatacagctatagtgaataaagtgtactgtcaagtagttttctcaggttgttgccagtggaccgtggtgttatcgttatggattataattcaaggtgtcaaatacttcaattattatatttttttatctaaaatataatcatgtgagatgttataaaaaaaataattataatgatgcaattgaataaaaaacagatgaatatttttttaaaaaaaaataattgaaaggtttgctaaacccaacctttaaagagagtatgtgagacatttcagcatgtacttctttcatcctaaaataaataaacctaatataatgtgacatattgtactacaaatctactatgaatctagatattatgtatcacatctcgtactacaaatttgaaccctagaaatctttatattttagaccggagagtatattatgcaacagtgcatatgaagatctctgttctctgatccccaaccaattttaaaaacacaatatatattggaaagacaccagaaacaagtggcaatgattatgatccccccaactcgtgttacatacaatagattacaaaaagcatattacaaaatcacacccaaaagaggctgccgcatgcaacaacaaaacaaaaacaaatggaagacgaacaggaaagggatatacattcattctcactagcagcttctacgaaagaaaacgagaggattctttaccaagaatatacaaacagaatgtcgcaaaaaaaaagaagtctcctcctaccttggactgttccaaggtgacgaagacttgtatgggaaaccatgattagctgatccatttcctaaatccaggctgtggagttgctccattaattgtgaccgccgttctttgaagaaatctagcctggtcgtcagttcgaccagagtggacgatgccacgggagcttgcctcccgtactcgacgccctgtgatagtgatacaagagaattgaatactcgtattgaatgagaagcggtgtggtctttatttcgacactaccgcacccttcagttcggaagcagtggtttttcctttacctcggttgccttcgggatgttcacggacatggaattgccatccgctggcatgctcgttgatgcctccctc

SEQ ID NO: 792 - DNA, 8429 bp, Oryza sativa
agtaaagtattagatatataattgttttcatctggaatcttcatcactaagtacatgcatatattcatcaacacaaattctgtcagcgtgataggaatagataaataacaaaaagtttctacatcatgccatttggattgttcctagctaggtgacaaaagccattaaccttatttcccaacctaactctcaaaagaaaaaaaaataaagaaaaacaaaacataatataaagattagatgaaaaagaaaatgcaaacaacaatcctcctaattaatcgagctgcacatgacacaaggccccaagagtgatgtataaacgacttccagaaaatcaagaagaaaaagaaaaaaaatgaagcaacaaacgtattctaattttgatagataatttcacttgttttactcctagataaactcagttacaacctggctcatcttatcatcattgcatcacaacaaatctacatggcatcacaaatcgatcgaaacaatcgaagagcaaccatctcacagtccacccaatttagattctttttccaggtgaccaaagaacaaaggaaatttattttggaagaaagaaaagaaacatatatcacaaaaatgcataaaaccacttccagggaaaaaaaaggtaaaggagaaaaaacaacaaaaactgagcaacaacaaactcaccgaattttgatagataaactcactttacaacgtggctcatctaatcatcgttgcattacaacaaatctatgtgtcatcacacacatcgatcaaagaaaaaaacccaagagccaaccacctcatcctccaccctatttggactctttccatgcgacgaaaccaatttacaaaccttacacaaagtcacacagaaagaagaaaaaaaaagaacgaaagaaacaaaaaggcaaaactgaaatcctcctcctaattaaacacacacgtaatctaatccagccactggtagtcacaatacgatgacgtgcccaccgctctaacactgtcactaaaaggttagacttttttgggttcttgtgcagagagagagagagagagagagagagagagagagattgtggatgcgaaaaccgcagctgggggcggcggttctgcgtcctcggtcgctttccatccggtgggcgcatcgcgtttttgcggtttttgcttctcttcttctttataaggagcagccaatttggtgcggggagccgtcgattcgccacgaaacccaacccgtcaacgctgccgctgaatctcactttctctctctgttcttggtgcttccgccgccatggctgctcccagcgtcgccgtcgacaacctcaaccccaaggtggtgatcctgcgcctcctcatgcccgtttcttgatttttcttttttttgttcttctcttctcttctctctctctttttttttgtgggggttgtagaggttcttgaggaaagattgcattttcgatgtgatgtggtgtgaggatagggattggctcggtttcggacttccggtggagtttaggggtcaaaaggagggattttttggtccctgttcttagttcgatttcttagcgtagcgaattgagcatccaatggtcctgatgttgtcatgggagtgattcagaaggggatatgggtggggcagtagggtgctcttgttttagataatggaagagttttgataagatggtgttctaatttgatggagtgggttgtgctctggttttttttctccagtgtagttatcatgcttagttcttgttcttgtgttctgcttgtctaaatctgtgaattcaaggtgcccagtccccagaaacgaggaattatcacacatgcagcgaggaggatctttcaattagcagggtagttgccatgagcaatttttagtctgcaaacagtaatagttttgtagttaattagagatgcagttcttttacttggatgctgttacttctattaacacagaggtagatctcagtactggttgagcagctgctggccttcagtttttgcctttttgccgtgatcgaacagtgccatgtaacatcagcatctcttttccctttcaaaatggaatatggcaatttcaatgaactgttgtcccacttctgctaccaaatagtgacatgaagatgctgaagcaccatattgttgtttcagtgagagcagagggtgctgctcacttgctccgatggcaacttgtgtcttgtgaagattcagttggattttaaggagataattatgcattagaatatttaatagcaactgcttttaacaagttctttttccctgtaggcttataaacctggaaaaaatattatattttgggtgttgtgttaaacaatggggaataaatatctgttaccttcctcatgatgtcattttcatgctatattggttcctactattattgaaaattgattatgatgctttgcctatttggcaagctggataatattgtgttattctaacactttcaaaagtactgcccgtgtggtctgcttttcattttcaacttgcgccattcaataattaattagcatttagctctatcagctgcactgaagcaaaacagtaatatagtatagtatcatggccactttatctatgtgtatatattatattcttccctgcaggaattattattattacagttacagtcacatgattgcttaactaaattgaatgtcatccactatcctgccatatagtcctaaaaattgatgcccttgacaagttcataacagttttagtttgagaatgcaattgcaatttccttcctgaagattacttgttctatttactggatttctagttattttctctccatctcttgatcaaccaggtgcctattctagtgcctaactaataagcttacccgtgcaggttttgaattgtgagtatgcagtgcgtggagagattgtgatccatgctcaggtatcttgagtgacgtcggtgtgttactttataatggttgtaacccgtgcagttttgatcttttttttcatttgtattcttcttgaatgaaaagttaaccagctagtcctatgaaccttttaaattaaagggatttttgttttcttgttcattaacttttaggtactttggcaatagaatagggattgaatagttgacagttgaatatagctgttagagcgttcggtgacaattcaattagtttgctgaacttgattatagaaatgttatttttatcgcacaatcttgcttgtttttttggaagtgttgaatccatatggttttgttggaacctaccaccaattagtgtcaattaattacttaactgcctagctcgcagagaataaagtagtcattgctgagatatataaagggagaatagtcagttaagtttcaccgtatctaacgaaaaggtttatcttgttgtctgtgtttgtctaacagtataaacttcttattcacatctccttgacttcccctgcagtagtaaactgtgctgttgtttttacaataattcaattacctgcttataatttgatatctatctgttttcttctgtttccagcgcctgcagcaacagctacagactcaaccagggtctcttccttttgatgaggttagtaactatcaatttaacataaaggagcttttcctggtagattattttctcattctgttttccccttgcagatcctatactgcaacattgggaatccccagtctcttggtcagaagccagttacattcttcagggaggtatgtggttatcttgccttcaagttttacattttgtttccatgatattcacatgctgtattgcaggttattgctctttgtgatcatccatgcttgttggaaaaggaggaaaccaaatcattgttcaggtgaatatcggcacctttatttcatcagcatcaaacagatatgcagagaacttaaatggagatatctagtgcaaacactcacattcctttagtttgcttaccatatacttcatccttttgtttctctctactgattgagttttgactagaaatattacatgttagttgagcataggagtttcaaaaaccaaaatcttattgagaaattttcaaggtggtttatccctagttaaaagggctaggactaaatcgattaactatgcaactggcatatcaccctaacttaatttctaaaagagttctgctcatgaacttccataaatagttgactatcatactgaaatttgaaattctagtgagtatctgatgccccatctttgctgcagtgctgatgccatttctcgagcaacaacaattcttgcctcgattcctggaagagcaactggagcatacagccacagccaggtgagcagctcaggctgatacatttactcactacaaagaaaaaaaaagaatcttaatttcaccgtactcatttttcctagggcatcaaagggctgcgtgatgcaattgctgctggaattgcatcacgtgacggataccctgcaaatgcagacgacattttccttactgacggagcaagccctggagtaggaactttaccttctttttaaatcttactggacattttttgaataaacaggaagcagttcgaatctcattatgatgctattctccccctctgttttaggttcacatgatgatgcagttactgataaggaacgagaaagatggcattctctgcccaattcctcaatatcctttgtactcagcctccattgctcttcatggtggagctcttgtatgttttgaattctcagcacattttcaatatggctgcattcatgctgcaccaaagcctaattgagagcattttgttttaggtcccgtattatcttaatgaatcaacaggctggggtttggagatctctgaccttaagaagcaactcgaagattctcggttgaaaggcattgatgttagggctttggtagttatcaatccaggaaatccaactgggcaggtttgcattcattgctttcttgtctaatttggagagcatcttggattgttgcaatttctgttcacaccatattctgcatgtatctacctaaggcatatatatttgcaattcttgtatctttttatgtgattttccattgttagggaacatatgtatttttgtttgtctgcaatgtgcatgaagcatttgcagctggtgcaggtacccaacaaaagaactgtaatcatgttttaattcatttgcaggttcttgctgaggaaaaccaacgggacatagtgaagttctgcaaaaatgagggacttgttcttctggctgatgaggtaagcgattgttacttgagcaactccacaacaaactttcagctgcttaattccttttcgctgtgctgtctgtaacatcaacactattcatattgataggtgtaccaagagaacatctatgttgacaacaagaaatttaactctttcaagaagatagcgagatccatgggatacaacgaggatgatctccctttagtatcatttcaatctgtttctaagggtaaatacgatgatctgttttcttattttctattggcactggattctcaaaaggattttcttgctgacaacaggatattatggtgaatgtggcaaaagaggaggctacatggagattactggcttcagtgctccagttagagagcagatctacaaagtggcgtcagtgaacttatgttccaatatcactggccagatccttgccagcctcgtcatgaatccaccaaaggtcaatgttctgtcattgtttaaatttctacctaagaaagtgcaaaagtctctaatcagataccattatttgattctgcaggctggagatgcatcatatgcttcatacaaggcagagaaagatggaatcctccaatcattagctcgccgtgcaaaggtataccaggattccaattctcttatactgctaaatgatatctgggaacaaattgtagaattgtttttttcttgatggcaggcattggagaatgctttcaacagtcttgagggaattacatgcaacaaaactgaaggagcaatgtacctcttccctcagcttagtctgccacaaaaggcaattgacgctgctaaagctgctaacaaagcacctgatgctttctatgcccttcgtctcctcgaggcaaccggaattgttgttgtccctggatctggatttggccaagtgagtcaacttaatctttatacgaagaatataatatgcttgtgcttgtatctgctgatactactggtttggacatattaagtcaaaacaaattttccttaaaagattcaacgtcactttttatgccaccaaataacaatcatggttttttttctcataagttcctgaatatatctttgtgttgagcttctgcaacaaatatctgaaaataatcatccctgaatagaacttctcatactattgcgttcttaccatgctatttggtcactagatattttgtactccctccgtccctaaatatttgacgccgttgactttttaaaacatatttgaccgttcgtcttattcaaaaaaattaagtaattattaattcctttcctatcatttgattcattgttaaatatacttttatgtatacatatagttttacatatttcacaaaagtttttgaataagacgaacggtcaaacatgtttaaaaaagtcaacggcgtcaaatatttagggaaggagggagtactaaaaatttattactggcatatggtgatgttatcaactaaaaagattcctgggacacatcatgtatctgcctcttttgttctgtttcaacaactatcttgttataattctgtgtgtccaaacctgaaagctactttgaagtttacgaacaataagcactccatgcactttattttttggcatatccatggtactgattttgttttcctcttctactccaaaggttcctggcacatggcacatcagatgcacaatcctgccacaggaggagaagatccccgcgatcatctcccgcttcaaggcattccatgagggcttcatggcagcgtaccgcgactgaattgccattcaccattgaacagatggggagttctatacaagcctgatggattttccccaggccttctttttttttgtccccatgatagcatcatcgtgtagaccaaaacaaaataaatcaaagccagacatgcttttttttagtgtgctaatcacagagggtactgaaaaactgatgccttcgatggcaaattgaggagaaatttacctgccatttcgttgttgtgcctgttactgtataaatgttaagattttggtgcagaggcagctatagttttgagatgttggagttggctgaactgtatgagaatggcttgatctgattgtgagacccaccagctattcatctctgatttgaatagcgttggttggtaggagtgctgctgaacaaaatgctctgaataaaatgagacctttcagtgtcttttactctgctgtgctgtctactgtaaatcacaacttgcaaatagtaaattttagtatagatttataatgcttaggttaaagattcctgcggcacatggtatttgttgccttgatggtagaaacagaatcccaataatttcaatctatttttaaggacttgtaaatatatgtgactggattaaatttcattataaaataaacatacttataagcatatcttaacacacttaattttttatagaagttggaaataaatcggtaaatgttcctgctaaactaagtacaggtaacttgtttttttctcgtgatttttgaccatttgccactctcttcaatggcacattctcaaatagtagcaacctcccagtgacttggattatttgtcacccgggtcaaaaaaaaatgtctccactttgccattcttatctttcagcttaggtagagtttattccaaactttttcttcaaacttctaattttttcatcacatcaaaactttcctatacacataaactcccaacttttccgtcacatcgttacaatttcaaccaaacttctaattttggtgtgaactaaacacacccttagtaaatcggatggaccgcatcccgtcgccaccatggatcgcgtagcaccgctaccgaccagagcggcgcccccgtagctccttgggagatcttaccacccgtcgccgttgtttccttatcgtctcctcctacacaggttagcgctgccgccattgcgtcgatcttaacggcaatcgctcggcacgagcggcagcaccgccatgggcttgctcgacctcttgcattgcttgtcattttaatgagaagatatgagagagaagagatcagggtagtatggtcatttgcttttccagtgccacatcactcaactgatgtggcaacgttttaggtccaaaagtggctttgagcaagtccccatgacaaataatcagttattggagagggtggcatttaagaatgtgacattaaaatagagtaagga

SEQ ID NO: 793 - DNA, 4150 bp, Oryza sativa
agagcgagttcccttattgaccagagcaaaaaggttgagcctgattaaacaaagtctatgagcttgcaggatgcgtctcttcccaaatttattcacaccaaagtcctcttcgatgacatcgccctatttgaatcttatcgttgacattgctcattttgctctttagttaatctgggcaaatgattggcggtggtacttcgtgatgtggaacagtgaaactgtttgtcaatctgtgcgctcgaggtacaaccaggtcggttcctttgctgttttattaataaaaggagcataaattagcgccaaaactcaagttttaccacaaaaaaacagtcagttttaataaagattaagcaaacccttgaattgcactctgtaaaatgtttgtttcccctcaaaagctgataaggacggacgccgatgtgaaacgaaacctgctatttcaaccatgtacatatataatcaagaatttcctacacgacttccattttttgtgtgttgactagtttctctccttcctggaggtgttaaaagagttccgattctgtcaaaacttccatacagataaatccaacctgtcaaactaccagctgtttaattattccttttcccattttgttatggtacacaaaggcacataaccatttacacggagcagaacagaataggatatgtattaaaaaaacagaatggagaaaaatcctgagtcacaagcacgaaaaatgaaggcgagattaattcgaaaccatacacatcatcatccacatctcgtcgtttgtctcacaggacatgacacagggagcgaaaaccacatcattaatcgcggcctacagctacacatccagattctcccgggatccccgaaacggctcccaccccgcaaccgccgcaagccgacccagccaaaggagatccccctccaccacggaagattcactgcgcggtgggccccgccgccaaaaaccaaaacgacgaaaccattccgcgtcatctctcccgcacggcgagcgagcgagcgagcgacctgacctcctcctcctataaatccggcgccagcgtttctccccaacctcccacgcccaatcctgccgccgtttcagcagctctagtttgaacgagggatcgtagagaggagggtttggtgagggagggaggaagatggcgacgtgcgcggcggacctggcgccgctgctggggccggtggcggcgaacgcgacggactacctgtgcaaccggttcgccgacacgacgtcggcggtggacgcgacgtacctgctcttctcggcgtacctcgtgttcgccatgcagctcgggttcgcgatgctctgcgccgggtcggtgcgggccaagaacacgatgaacatcatgctcaccaacgtgctcgacgccgcggccggggcgctcttctactacctcttcggcttcgccttcgccttcggcacgccgtccaacggcttcatcgggaagcagttcttcggcctcaagcacatgccgcagaccgggttcgactacgacttcttcctcttccagtgggccttcgccatcgccgccgccgggatcacgtcgggctccatcgccgagaggacgcagttcgtcgcctacctcatctactccgccttcctcaccgggttcgtctacccggtggtgtcccactggatctggtccgccgatgggtgggcctctgcctcccgcacgtccggacctctgctgttcggctccggtgtcatcgacttcgccggctccggcgtcgtccacatggtcggcggtgtcgccgggctctggggcgcgctcatcgagggcccccgcatcgggaggttcgaccacgccggccgatcggtggcgctcaagggccacagcgcgtcgctcgtcgtgcttggcaccttcctgctgtggttcggctggtacggattcaaccccgggtcgttcaccaccatcctcaagacgtacggcccggccggcggcatcaacgggcagtggtccggagtcggccgcaccgccgtgacgacgaccctggccggcagcgtggcggcgctcaccacgctgttcgggaagcggctccagacggggcactggaacgtggtcgacgtctgcaacggcctcctcggcgggttcgccgccatcaccgccgggtgcagcgtcgtcgacccgtgggccgcgatcatctgcgggttcgtctcggcgtgggtgctcatcggcctcaacgcgctcgccgcgcgcctcaagttcgacgacccgctcgaggccgcccagctccacggcgggtgcggcgcgtgggggatcctcttcaccgcgctcttcgcgaggcagaagtacgtcgaggagatctacggcgccggccggccgtacggcctgttcatgggcggcggcggcaagctgctcgccgcgcacgtcatccagatcctggtcatcttcgggtgggtcagctgcaccatgggacctctcttctacgggctcaagaagctcggcctgctccgcatctccgccgaggacgagacgtccggcatggacctgacacggcacggcgggttcgcgtacgtctaccacgacgaggacgagcacgacaagtctggggttggtgggttcatgctccggtccgcgcagacccgcgtcgagccggcggcggcggctgcctccaacagcaacaaccaagtgtaaccaatccagaacgaacgacgtcacagcgaaggaagaaatcacgggtttctctccctctccgatctcgatcgtcacgtcataaatttgatccccatatttgattgccagtttctgtttgggccaaatgcttttgccgctctctctggtgttgcaagactgtaaaaacactgtaggatggacgagtgtctttcacttttgctgggcttctcttgtgtacaggcatgcgtacgtgtcttagaatgtgtggtgtgaaggtgggaagaatcagaggttagggtttaattttcttttgcacaatggttactgctattattgttttattttgtggtcgaattttatcgtcataagggtgtggtggaatggtggtcaagataggtggctgtgcagggctcaaagactttgcgtgggtccttttgtcctgcagtgctctacctctctatcaaaactttggcttatttcctggaatctagtggtttgagagtgtttgttttatactcagttctgcattatgtttacgatatatatttttttttaccaaaagcatttcatttaaactctaccgagagtacttgtttatgctgaatcagtacatctacactgagtgatatttagagccttatactaattgaagattaaatagtcaaagtccatgtgcacatttctactcgccagttagtctgaaagaaaagattcctgtgtgcaattgtgcatatcagcatatgccacctggcgataaagtaaacatactatagttgtgaactgtgcgatgacaacgaccaaattaagcagcctgatctttacaacgaccgctgtatagagaacagactatatcaagttttggtccgctgttcttcttttgggattgtgaagcatgaaaatactacagttttgcatttctttttcccgtaaatgtggaatgcatctcgatatgatatggctattttagcaattgatctgtctcctttttttttcccaaaatacaattgatctctcatctgtcgcacacagccacgatatggtatagagttaattttggcatttttggcaatatagcacattactattatccccttaaatattgtgatatctgtttttcaatatatctgctcgttgcactgattagtccgcaaaatgaggtctgcaaattgctcggtacagcttttgactatatatattaggataaacggatgctttctcgtcttgtagttctgaattgcaatatgttttcctctttttttaatcgacgacaatatattatccattcaatcatggtctgtagtaccttcctgcagtacactccctacctgtaaatttcaaacatgtatgcaccacagtacatactcctacatctctctttcaccaatgctgccaaataagacgctaggagattgaaagagattggatagcacaacatgcgcttgcctcacctctctcaccagtcaccactcacgacaatacaggttgatacgcacggctagcactgatccgcaaacacccc

SEQ ID NO: 794 - DNA, 3872 bp, Oryza sativa
ctatatcggtttattataatcttattataattcagtttatagtaatctagctcaataatatatattataataatcttaaactgaaacaaacagggccttagaaattcatatgttttgaaatggagatagtaccactcagaaagcttgaaggatttcatgtgttttggttaacatattcatgtgtgtcttttcgtgcaaccaaaattttctttagaaacatggtgaaccaattagatttagaaattataaaatatttccaagtgttacaagtggaaatataataaaaataatattgttaaaaaagtaaagaaagtttaagtacaaacagaggaggaaatataacaagtgcttcactatagacaaatatagaggaggacgaaatgtacaaacagtcgtttttactttttaaaagaaagtacaaaccactgtattgcgactcaggcgttgtttagatcccagaaaattttagccaaaaatatcacatcaaatgtttggacacatgcataaggcattaaatatgggattgcgagacaaatcttttgagtctaattacgtcatgatttgaccatgtgatgctatagtaaacatttactaatgacatattgattaggcttaataaattcatctcgcaatttataagcagaatctataatttattttattattagtctatatttaatacttcaaaatatgtatgcgtgtacttcaaaaactttatatcaaaaaactaaacacagcctccaggccgcagcctacagtaggcctatagagagattccacgggattcgatgaactacgaccacgaacaggagggggacaaatcaacaagcaaatcataggggtcccacatttcagaggtagccaaagattcactggcaggtgggcccttcacactttgaaggaatcaacaacgacaccccccaagtcatggattccttctcgctccctctccacgtcgcctataaatccgacgcggccgctccccactccacccacagcccacacttccattgctcctcccctctcctctacagtctgtgttgagcgcgcgtcgaggcggcgaggatggcaacgtgcgcggataccctcggcccgctgctgggcacggcggcggcgaacgcgacggactacctgtgcaaccagttcgcggacacgacgtcggccgtggactcgacgtacctgctcttctcggcgtacctcgtgttcgccatgcagctcggcttcgccatgctctgcgccgggtccgtccgcgccaagaacaccatgaacatcatgcttaccaacgtgctcgacgccgccgccggcgcgctcttctactacctcttcggcttcgccttcgccttcggggcgccgtccaacggcttcatcgggaagcacttcttcggcctcaagcaggtcccacaggtcggcttcgactacagcttcttcctcttccagtgggccttcgccatcgccgccgcgggcatcacgtccggctccatcgccgagcggacccagttcgtggcgtacctcatctactccgccttcctcaccggcttcgtctacccggtggtgtcccactggatctggtccgccgacgggtgggcctcggcttcccggacgtcggggtcgctgctcttcgggtccggcgtcatcgacttcgccgggtcaggggttgtccacatggtgggcggcgtggccggactctggggcgccctcatcgagggcccccgcattgggcggttcgaccacgccggccgctcggtggcgctgcgcggccacagcgcgtcgctcgtcgtgctcggcagcttccttctgtggttcgggtggtacgggtttaaccccggctcgttcctcaccatcctcaaatcctacggcccgcccggtagcatccacgggcagtggtcggcggtgggacgcaccgccgtgaccaccaccctcgccggcagcacggcggcgctcacgacgctcttcgggaagaggctccagacggggcactggaacgtgatcgacgtctgcaacggcctcctcggcggcttcgcggcgatcaccgccggttgctccgtcgtcgacccgtgggccgcgatcatctgcgggttcgtctcggcgtgggtgctcatcggcctcaacgcgctggcggcgaggctcaagttcgacgacccgctcgaggcggcgcagctgcacggcgggtgcggcgcgtggggggtcatcttcacggcgctgttcgcgcgcaaggagtacgtggaccagatcttcggccagcccgggcgcccgtacgggctgttcatgggcggcggcggccggctgctcggggcgcacatagtggtcatcctggtcatcgcggcgtgggtgagcttcaccatggcgccgctgttcctggtgctcaacaagctgggcttgctgcgcatctcggccgaggacgagatggccggcatggaccagacgcgccacggcgggttcgcgtacgcgtaccacgacgacgacgcgagcggcaagccggaccgcagcgtcggcgggttcatgctcaagtcggcgcacggcacgcaggtcgccgccgagatgggaggccatgtctagtggaaccggaggagctgagctagtagtacatacatgcagcatcatcgatcgaacgaaatgcatataagcgtttttcaaggttgatctgatgctgcaggtttcgtgattgtataataggaagaaaaagatagtagtattttttatctgagatcatctgtttggaacaggggatttgactaagatttgatataaatttacacaaaatcttagcaaaaatccctttatctcaactctcaagtagagctttgctttgtacaacaaagtatcatgtgtgatataattgtcaggtggaaaaactggaaacgggtataatctacctttctttgtcaatgatcgggtgaccacatgaggagagagcccgtgtttgctatcaggttgaaaaaaaaaaccatacgtaataataaataaaaggttgacaactgtggtatttgtagtttgtacaccacttatatgatttttttttgtacttcccgaatgcgtgttcagtaatgtataggcgactgctaggagaatgcatataacgtattaacgtttgactttggaccggtacaggagcagagatatgtgccagtttggtgcactctcaaataatggaagcaaagtttttccccctatttaattttataggatttttataggaattgatacatttcgttccaaattatttgaaattcctatgtttcaaagggacccttagaatgaacaaatttatcgaagttgtatgtgattttattaatgaattagatcaatgatcgcgtgaattgagagaaaaattcatgtttccaaaggagatattagtattgatactcctttggttccatattaattaacgttttggacaaggttaaggtcaaacttttataactttaaccatcaataactttaaaaatatttagtttaaaggaactagaacaacatatatagatttgtcttttaaagcactataataaaaataaatatgtatttatttattatatatattataatagaaaaataaggtcaaaaatatatcttgtagaccgtgtcattgttcaaaacgtcaattaaaatgaaaccggagggaggctaggctcatgatattagaatttgaaatgatcgccttgtcgttctgtcttggagtgataaggtcatggaggaactccaggctaggttagttcttaactcgttccacccgtgattttttatggcgcttgaaagctacttgaggtatttagacttaaagacttaaaaaggaaatgccaatcatttgtcacacttaggcaactttcaagtatatgtgaaacgtctccaaattaatagttatatgatgggatctt

SEQ ID NO: 795 - DNA, 3845 bp, Oryza sativa
ctgacaatttttgaagataagtgaatcacatgtctttctcaatgaacttaaatttatgaatgaaccaacctatacatgaaactaaatatgatatcaagatcagttaaaaatcttgttttgtgaaatttcaaaacaaaaaaataaaattgcagcgtacctttatttcaagagaaatttaattcactaaaaaaaagtaattgtatgtgccaaattttacattaaaaaatggtatctgcaatgtattcttaaggatgataaaattatctcagtaatattcaatcattcattaatagaggtgaactgctcgttcttttactcatcacacctgttggatgaaaagattggttgctgccactaaaaaaattaatcaactcattgcagttggcaaaaaagaaaaaaaaaggttttcaggcactagtatatgtgatgttagaagggaaactattctaatccctcgaggggatgttccctcgtttactcaaaaaccatctaaacggttatgaaaaattctgaaaaaaattgacaacattcatacaacacatatatacaacttcacaaaatcttaagtccaaaatcaactcacacttcgagatataaaaaagacaaattcagcgtatgaatagtagcgtactgtttatatctaaatttgtcttttttgtttctcgatgtgtagatcgaatttgaatatgaattttggtggactagtaggtatcattatactctacattgttaatttttttcagattttttccatagctatttacatcgaatttggaagaaaaaggtatacgaggggatatccccttgaggtattagaatccactcccatgttagaaggaatccaaaacagtatacatgcatccacgcgcacctcggttttgcatttcccgctgtctgtgatcacgaatcatccaattaaaaacaaccatcaaccatggattccaatgtgttctgcccctataaatagtccagcatctcattctctcgtctacttcaaagaatcacacaccaaaacctccattagttcctaaaccctagcaagaagcagcacaaaaccttgccacacttggctagtgagacacaccatggcgacgtgcttggacagcctcgggccgctgctcggcggcgcggcgaactccaccgacgcggccaactacatctgcaacaggttcacggacacctcctccgcggtggacgcgacgtacctgctcttctcggcctacctcgtgttcgccatgcagctcgggttcgccatgctctgcgcgggctccgtccgcgccaagaactccatgaacatcatgctcaccaacgtgctcgacgccgccgccggcgcgctcttctactacctcttcggcttcgccttcgcgttcgggacgccgtccaagggcttcatcgggaagcagttcttcgggctgaagcacatgccgcagacagggtacgactacgacttcttcctcttccagtgggccttcgccatcgccgccgccggcatcacgtccggttccatcgccgagcggacgcgcttcagcgcgtatctcatctactccgccttcctcaccgggttcgtgtacccggtggtgtcgcactggttctggtccaccgacgggtgggcttcggccggccggttgacgggtccgttgctgttcaagtcgggcgtcatcgacttcgccggctccggcgtcgtccatctggtcggtggcattgctggcctgtggggtgccttcatcgagggccctcgcatcgggcggttcgacgccgccggccgcacggtggcgatgaaagggcacagcgcctcactggtcgtgctcggcaccttcctgctgtggttcgggtggttcggcttcaacccggggtccttcaccaccatctccaagatctacggcgagtcgggcacgatcgacgggcagtggtcggcggtgggccgcaccgccgtgacgacgtcgctggcggggagcgtcgccgcgctgacgacgctctacggcaagagatggctgacggggcactggaacgtgaccgacgtctgcaacggtctcctcggcggcttcgccgcgatcaccgcgggctgctccgtggtcgacccgtgggcgtcggtgatctgcgggttcgtgtcggcgtgggtcctcatcggctgcaacaagctgtcgctgattctcaagttcgacgacccgctggaggcgacgcagctgcacgccgggtgcggcgcgtgggggatcatcttcaccgcgctgttcgcgcgcagggagtacgtcgagctgatctacggggtgccggggaggccgtacgggctgttcatgggcggcggcgggaggcttctcgcggcgcacatcgtgcagatcctggtgatcgtcgggtgggtcagcgccaccatggggacgctcttctacgtgctgcacaggttcgggctgctccgcgtctcgcccgcgacagagatggaaggcatggacccgacgtgccacggcgggttcgggtacgtggacgaggacgaaggcgagcgccgcgtcagggccaagtcggcggcggagacggctcgcgtggagcccagaaagtcgccggagcaagccgcggcgggccagtttgtgtagtaggatcatatcgatcgtgtccgtttggggaaagtgttttgtgaagtgtgcatatataagctgaggcagtcgtgtgggcgtggtggcacttcagcccatggtggttgtggctttcttttgatatttgcttcctttcttctctgcatttgcacctgtatggatttttgtggctttcttgtacatgtttagacgtgtcctgtttgtatcagtatttaggtcattatgatgttaacgtggagctcggcatatgccatttgggagaatcgctgcgagatggtccaaagtatcctcctatggagaaactagcttgtactagactactgctatagtagtactacaagttttttttttaacgatcagcaccaccagacaacacgatgattcgttgaatagtagtacaaggctagtatcttggaagacagtagccaggaaagggaagaaaaaaatttcaccaccacgcactaacaacaaatacacatagttcaggagaaagcttgcactggaccgaccatcgcaaagcgtgattggtcgccactagaccaacaagcaaactacagctaagaccgcccaaaaccaagccctacggttgaccaccgatctcaattctagccatgtatttgagattgagagggagagggtgagagagaagaaggaactactctccctcctagggcccgccaacgtggtcgacttgcataacctagagcatcgtcacaagagcacaagacatctagagcgagcatgcaccagctgcctaagaggagttttggcaagggaccttcctagacgacatctctagggagaagagcgacgatgagcaccgctgctcctctccatcaaggtcttagagagaaccaagacagggttttcacgcggcagcctagttagaggaagaggatggctcgacaacacttctgagagggaagacgacgcccaaagcgccatcgttggtggcccggccaagatcgggctaggtttacactgggtcgctcttcccttgtagatccatagctaacgctctattgctccaccatcaaccatcctccattgacgcgtggacactgctccaccgacgccccctgtagttgtgcctcccgcgtccacccgctctccgcacagtcgccggctgtacctcctagccaagctggcctcttgtcgctgtcgaccacgtcttcacgcactgcgtcggcccgccgatagcaccttcacgcgccgcaccagcctccccgcgcaatgccgacgccactccgcaccccctgctcc

SEQ ID NO: 796 - DNA, 2989 bp, Oryza sativa
caggagcgagtagtccaccaactgtccaagtccagacgatcgagtgacgtgttgcattacgtcactgagcgcatgtctgcgtcgccgatggcgcgacgccgtctacggccgcctggccggagctattatttggcgtgttctattacgcctcacagtacttgaaacgtttttttttccctgtataaatcacttcaatcaaatattgttatactgctccctgcaggtcttccctaccaatgttggatgataacccgaatgtacctatcagccaaaccccatccctaactccatggcttatctatgccgacactttgctggagacgacaccacacctggcgggtcccccttgtcatcgtcatccgattgtgccttccctgattttcttacaagggcacgaaagtacatgatcacaccgttgcagtttaaaacgtgtactagtattaagtttgcaagcaagatctgtacagccacgcacttcttatttctcaacaaaaagtcttcgattaaatttccgacggagcgagtacagatagcacatcatacgtacagccgccgacgacgacgaaaaaaaccaaacacatgcaccgagacattccaagacaaacgatctgatcaataatcccgctgctgcgagagtcagcggtcgaccgtgtccgctggtcgcggccccgcagcccatcatcaccggaccgatccattccatccatccacctcccccccaacgcaacgctctcgcgtccgcgtcgcggcagctgtcgtcacggatccggtgtccccggccgcggctgacgcccctccacgccatcagcccatcaccccccgcccgcgactcgtgcgcagtccaagcgaaagctaccccaccacccccccccccccccggcgtcgcgcgggccccaccatactactccgcgggcccccacggtgacgtcacccgcccacctcacctccggggctccgaccccccctgcttcttccgtgtgtgtatatatccaccctccacctctcgtctccccgagccatcacgccaagacgtactccctccttccattgttacacgcgttcacaaacggccagcgagacgacgtcgtcgatcggcgaagctagggtgggtgcgctgcgcgcgtggcgccgccgcgagagacgatcaggccgggggagcaatgtaccaggcgatcccgtacagcagcacccggccgtggctcaggccggagccggcggcgagcgtggtcgacgtcgtgaaggtggagacgacgacggccgtcgcgggtcggggcggtgaggcggaggtcgtgggggaggaggaggcggcggaggtgcggagggcggtggcggagagcccggtgctggtggtggggaggcgcgggtgctgcctcatccacgtggtgaagcggctgctgcaggggctcggggtcaacccggccgtgcacgaggtcgccggcgaggccgcgctcaagggggttgtgccggccggtggggaggccgcggcgctccccgccgtgttcgtcggggggaagctcctcggcgggctcgaccgcctcatggccgtccacatctccggcgagctcgtgcccatcctcaagaaggccggtgccctctggctttaaatcaccatcatcttccttctctccttccaatttttttcttcctttcttcacaacatcgtgccatcgtggttcaatcctggccgttggattcggttttacatcgcggcggatttcctctaggatatttttcctcctccttttccgtagggtgtgctaagctttgagaaaaagaaccagagagagctaaagctaatgttgctagttaatagtagtaattcatttagcaaaatatatcttcgtgcgtgcgtacgtgatgatgagtattttactccccaccatgtgaatacggagcgagagaggaagagggacagtgacatttgccacatctgtacagttttgcatttctgaattaattaatgagaatgagacgttcattttgcccccatttcctgtggctttgagcctctatcttctttcccctctttactcaagttaaaacgattaattaccctccgtatacggcattgtggtttggtgagaaggtttacctcgatgcatgctagctacagcatgcattcagatgacatcatgcatacggcagattttctatccacccaaaaaaaatcagccttaaaagtgtagtttggctcgagatctatattttcacagctaattcaatcgcatataacaacaagttaatcaactgttaacgatcaggagtagatttgctttggagaaactgttgtgagagggaaggctgtgtttgttaatttgtgcccgtacgtgttgcatgggacaaagatgtacgtaagcagtgatgagctagcgcagggaaattttcggtcgaacagatcagcgagaagagaaatccaacttctccttgtgagatcattgcgcggctcgtgtggtccaggcgtggctgattggcggaagccctccacgtacaaggtatttacggaccaattgaccccaactaattgcttcggcagcgacgggatctgcacgagaccggagcaaaaagataaaagggtgtgttcggttcacgctaaaattaaaagtttagttgaaattgaaatgatgtgatgaaaaaattaaagtttgtgtgcaggaaaattttgatatgatgaaaaaattgaaagtttaaagccaaagaaaaaaaaacttcctatcacggagtacgaagacagtacacagagtctgcagcaaccggttcattcctcggacaatcaatcatggaggggagagttctctctagtcagacttttggcgttgttcagatatccatggcggtttaattttcggtgtgtcggatagtatttactagctgttttcagtgtatcgggttaattcaggtgagctgttcaccaaagatgaaaaatgaaggtaaggaatttgactgatcttctaactagttcacctgaactggctgaacatcgtttggaaat

SEQ ID NO: 797 - DNA, 6815 bp, Oryza sativa
aaaaaaatattaatgttttggcccagcattgagaatattgaagcaaagttctgcttgtttatgcttagacaaactctcaatatgtcatcaatccgattaataatcagtgttttatcctcagttcttaggttaaaaaaccttgtgtcatttctttctaaaaacttgtaataaattgacaaatcattgacatctgtggagtgtatgccacggccgttgtcggatttaacatttggaaagttattgtctatgcaaatacagagcagaaatgtgacgaaccaatcaatgatcattgtcacgttgaggtcaacagttaaaaaaaaaaagattccgtggatcaattggtgatcctttttataaatttgttggctgatgtctactattggaggcctgatagatacatcaaacctctacctcctgtatttctcagaacagataagaaaaacaaagagaaaaggggtcgctcctttttggcttggaatgatgacgtccaattctttgtttttttgtcatggagatgtagttaaccagaagcatggtttttgattacttgtgatagccgaaacttattaatggaaagcagttacaatttgtactgctctataagagctattctactctaaaatcttaaggacacaaaattaagtaagcaacagtcattagcaatttaggttctggataagtgaccatccaacagaacaaggggagcatcacggccaaattctttgctatactatacatcatcatcaaacgttatttcgaataaaaatatgtctaagtatcaaggcagcattttgtgtctttctttcccttttttcatttaaaaatagagctcgcatattcttaggtcaacaccgaaaactaatcaccatgttgactttgaattatttaaatcaatgtaactcaaaagttaataaacgtgaatgtgcaagcatacaaaacaaactattttgtattttagttgcacgatcatgttcacttacaaactcttttcctcattatttggaaaactgacccactatattttgctcctccttttagttgtaaacatccttctggaaatacatatgtgcacaagcacagtgctcacataattcatgagttggacaccagatgaaaaaaaaccccaagaaaataataagtggagtaaacttccatccaacttaagttaccacggtccacggttaattcctattgactacgaacaaattgttttactatgttaaccatgtttttttagacaatagtgtcaaattatcatattacgtatgaatttatgattacacctcttctttctccctgaaaatactgcagcatcctctcgatttgagatgattacttcagtttcttgccacaccagaggtaatccattcccttgatttttgttaaaagataaagataatatagacgctatctttttaaacggccaatatcattattaatcaaataactgaaaaaaaaatgtctctgaatgatacttgcccctacttcgctatccacagttgcgatttgcgacttgcaagcacaccgtagctaacttctctccttctgggtataaatatccctctcctctccctgtttctcctcatccctgcttcctcttctacacctcattttccgcttgcatcttgctcattcagatctcttctgctttgagcaatggccaacctcaccgacctcgttaacctcaacctcagcgactgcagcgacaagatcatcgccgagtacatctggttggcaaacctcctctgcttttgatctgttcttgatttcttatattcgtctgcactagcaagtctcctgctgcactggtgcgttcttcaaggatgcaagatcgcgtttttttgtgcgaaattaatctccatttccctacctatgatcgtcgtggatcgtgaaaattgatgattgttcgcttcctgaattctaccactgatcaaacttttctaccaagtttctttgatacaacaacctgaatgatcttcctcgtctcaaaacgtcatcttttttatttctgttcagggttggaggatcgggcatagacctcaggagcaaagcgagggtgagtgtgtttatctcaacatacaatcctggactcattatgatcactaacactatcacaattctgaattttctcaccatttttgttcttccgttttcatcgagcagactgtgaaaggccccatcaccgatgtgagccagctgccgaagtggaactacgacggctccagcaccgggcaggctcccggcgaggacagcgaagtgatcctctagtatgtatatggccttgttctcatcgtctcttgtgatggttttactttgtagattaccaaaggttctttgtttcttatgccttttaacatttttcttttcttactttgaagccctcaagccattttcaaggacccgttcaggaggggcgacaacatccttgtaagttcctctcacttctcttgtactttttttttgctttgtagctcatgacatattgacactttatgatggccaaaaggaagggaacgaaaggtcctttgcaaacaaaatttgaatgtgtgagatggtagatttgttgtagaaacatattatttcaggcactgttaagtgttaaccttgttgaattgtagcttggtctgaaaaataaaattatgaatatgttaactagtagttaggttattttttctggctgttggatgtgctcgaaacctttagctgtttatcttgctcttagccagcaaactgcctacaccctgatgtagacatgccaaaattcttacatcattgattggcctgctcgtactttatggaattcaactcttgtgtatagatataaattagcctgttagaaacattggccacgaatagcttccgtactccttccgtatcaaaataaaacaatttctggaatttgaaatttattccaaaataaacaccttctatcttcttaactatcgtcaatccgcaaagcaagaagttttattacctcaatacccccgacctaccagtaaatcaatacaactttcacattaattgagggcattgtggtttctgtttctctccttaaaattttctttggatgttagggtttaagttagggagaaagggggtagatgtacttcattcagcttaaagcagtaactgcatagcccttaattttcaactatgcctaagtttatttccaaactttttttttaaactttcaacttttccatcacatcaaaactttcctacacacacaaactttcaacttttccgtcacatcgttccaatttcaatcaaacttttaattttggcgtgaactaaacataccctatatcgggaagtcgctggtttgcttacttttttaatttaatgttactataggtgatgtgcgactgctacacgccacaaggtgagccaatccccactaacaagaggcacagtgccgccaagatcttcagccaccctgatgttgttgctgaggtgccatggtaagaaccgttctctccagattattaaagtatttttgcatacgacttaattaaaattttaactccgttgttaaaaaaaatccttgtttccaataaatataagcatgtcagaactttcaagttctgaaacgattgttatattcaccaagtgatttaaattactacttggtgagtagtaatctagatcatttttgttgacacaaatataatagtttagtttagtttatcaaatagctaaatatgaaaactaaaagttttcaaggccgttcaaaataaaaaaaagtttttaaggaccaccaaatgtggagacccccaaatctatatctactttactatcttatctgctataccattctcataaggttttatctctgaatccaaacaggtacggtattgagcaggagtacacactccttcaaaaggatgtgaactggccccttggctggccagttggtggcttccctggcccacaggcaagaaatcactgctcaaaatattcatagttactccatagaatttagggcattagaatcttcattaaaatagactttgtttggtagtattgttgtgaatttttcaacaaaaatgttcttgctttacccaatagaaacaatgtttgaaagagtttgaaagaggagtaacatcctactattgcaaattatataaaaccaagctatgtgatgtacgtgaatgtgatgtcagaatttgaaaaatcaaagccacacttgcagtttttattaatctatggtagttgacttgctgaaaatttacaaatccttaaattgccacttgagccttatagggacttaactgaaaaaagaccagctctagtgtcatgaatagcaattagatatgcttgtgtcggtaatattttcccataaaatcctctgtaattttctgaactttgttctgaattttttttctctctcagggaccatactactgcgctgccggtgccgaaaaggcgttcggccgcgacatcgtggacgcccactacaaggcctgcatctacgccgggatcaacatcagtggcatcaacggggaagtcatgcccggccaggtacttccaacgaaatctccatattgttctcttcatcttatcaccaccgggctccatgtaccatagtatggcacatgaacacgacggctgatacgtgtgctaattctgattctgaatcggattctgtgggtgacagtgggagttccaagttggcccgtcagttggcatcgccgctgctgaccaagtgtgggttgcccgctacatcctcgaggtacgtacaaatcatatcctgatatgatatattatattattctcggctagcttggattaatcggaataagcatcgcgacaagtacaccgctcaactgcgagcagtatatgttccagttctgcaatgttactacatcttaattaattagtacgttgaggtttagctgaacttttgtcgtggttgattggttccagagggtcacagaggtggccggagtcgtgctctcccttgacccgaagccgatcccgggtgactggaatggcgctggtgcccacaccaacttcaggtagcagcagtaacaattttctagctctctgatgctgtgagtgagctgcaacacaggtggtttatgtgtgcattttgtgcattttgcagcaccaagtcgatgagggagccgggaggctacgaggtgatcaagaaggcgatcgacaagctcgcgctgaggcacaaggagcacatcgccgcctacggcgagggcaacgagcgccgcctcaccggccgccacgagaccgccgacatcaacaccttcaaatgggtacgtgtatacacgcatacgcccgccgttcgtcgatcgatcggctagcctaccatgagatcataacctttttttgcgtgcgtgcgtgcagggcgtggcgaaccgcggcgcgtccatccgcgtggggcgcgacacggagaaggagggcaaggggtacttcgaggacaggaggccggcgtccaacatggacccatacgtcgtcaccggcatgatcgccgagaccacgctgctgtggaagcagaactaagccgtccggcgggcctctcccgtgcatttctgcgcccaaaaaaaacaaaaaaaagaaacgtacgcgtgcgtgcatcagccgtgatgtgtcaacgttggatttcggtctcggtctatccttggcgtcgacaaggccctttgaattttattactagtctgtcctgttcaccgagtgtcattttgtgtactctgaataataatgctttgtaaaacggatttgctttttccgtagggacggatgttcttgattttcctatatcgtgatttatatatatggaaaaccgctgtctttttttgttcgatcagcttgtctgtttgttcgatcgggttacatcttctccactctttacatgtcactctgactgatgcgaataacttcgatggatggatgtaaacgtctgtgccaaatgtgcaaagtgttgcactttgagctagcgtgttgcaggctaaaagcaaaagagaaactgcctcgtatattttttgaaacctacggtcaggccgttgccgacattttatattaagaagaagatatcccattttgagaagaaaacgggatcaaactttacagtgctcagttaattagagaaaactgagcgaaaaccacaactacaacacctcagttaattagagaaaactgagcgaaaaccacaactacaacaccacaccaacagctaacctatcctaaactaccacgacagagcccgacacaaggcatcggccaagcttgccatttgagacaacacggcagcttacacatgttatcgttgccaagcttgtcacccaagtgacacagcagcttcgacttcaatgtgatgctatcccaacgccaaaatgaacaaacaagaacgacacccacgaaggacatcagcccaagctaccaaggaaccactcctacacacagctagcatcaacaatcctataaagaaattgcagtgtgtcattgttgccaagcttcgtcgcccccagcaaagcagttccgactctaccccacagtaaccagataagagtgatgaacacccgttgtagcaaggaacgaagccaaggaagtgaggcctcgtcaaacaccctagacctgaagagctttggggacattgcaggagtccaccaaggctaccattgcgcgtagagggttcttcgtgttacgaggggtcaatgccaggacgacgcctccaaggaggggaacggcgccaaatggcgtcgccgtcgtcatgccagcccatggcctggcaaggctttcgccagcggtttcccatcaaaaccccacacaaccatcctgcacaacgaccatcgccagaccaccac

SEQ ID NO: 798 - DNA, 8731 bp, Oryza sativa; identical to SEQ ID NO: 231

SEQ ID NO: 799 - DNA, 13707 bp, Oryza sativa
gctccccgcgtcggcgtcggcgcggcggcggcgcgccggccgaaccctggccgtcggatcgggcgtcgtcctgggccccacgcgccacgggcggctgtcgtttgctcctcggagcggggtgggcccaccatggccaccaccacaggtcgcggtcgcggctgacctggcggtggtcccgtgctcgcggtgttttttttttttcactctctttctctcggtggacagtagcgggggccgcggcccgcgggggcagagattgcaaaaacagcggaaacggaagattgcaaaattgcaactgctttcctgtttttaattcgggatcaaaaagattctttcgtcggggtccccgtgccattgttgtattgcgcgtaggtccttgcttgtaaaagataatctccttaattttttctttgtactactagtgtatatgcagtaagaatataccatgagtaaaatgaaccacaaaactaattacgatataccattctcatgtagacgttctcttttcttttgctagtcatacgtgcatatataaccaaacaaaaaaatgtttgaagtactcctatccaatttattactccagtagacaacaaaagaaaatgtttgaagtaataactgatccatggtacagtagggttgtcgtcaatcttgtgtttctttcattccattgtacttacaatcgtactccagctagcacagcacaatgggcttaagctttggaccccaaattctgatcttgtcggggacccgtacgaaaatactcccgtagagatgcagataccgtcacaacctacaaccaacgaatgttaagaaaacaaagggaaaaaaaaagaggcgaattcggaggagaaaaaacggtggctaaaatatagtgcgggtgtggggacgcgacgcgagcgacgaaagaggagagaggatgggttggcctgcccccccctcccctgtctataaatgcagaggcgccgagtgccctagtcgccgctcaactcggaggaggaaacgggaagagacccgcgagagaggcggcgccccgtttcgtccccaaaaccgatccattcattcgccaaccacgccgtccgccgcgtcgccggtagagaaggccgccgtgcgtgcgggagagaagggggaagcacaaaccgcgctcggggacgagagccgcgaggcgaaggtgtggggaggatcgggacgcggcgtcggcgtcggtctcacctccgggctacaagagcgagaggtacccgctcggccgcacgcacccttcctcatcgtcgtcctcccaacttgacaggatcgggagacggttttccaaaaaagaaaaaaaaaacaagttgctcggcttttggggttcggtttggctttgtttggttgggttgtgcgttgtggttggtggtggtggtggtggccgccggcgtcgagagctctccgcctatcggcctatgtattttttttatgtttcgatctactggtggctcgctcgattctgcgttcgtgcgtgccggtcgtgtgggggcggatggaatctgcgtcgccgtgtgggggttggtagatctgttcatcccccgcgtgtgtcgccgtttgccctgtgtgcgtgtatttttctcgttttgcaaattgcaagtgctgtgctgtgttccatcgcagcatgacacgagttccctcccgttgcttttggtggtgacatgtgggaaagggagattgctttgaggattttctgttcgtttgtctacttttttttttctcttccctgctctgtatttttgtgatgggattttgttcgttttcttcttcctggtggtagaagtacggtctaatgctcgtcgtttgatgccgcgtgacaggtagcagagggagagtcgtgaggtgcagccatgtcggcggcgcaagggatggcctacaagctccgcaccgacgcggcgcccacgggcgctggccgcagggctcggcgcagccactcctccgtggcggcgccttaccgcgcggctaggctggtacagggcggcgtgtccatcgagggcggtttggtcggcggatgccagctcaccgaggagcgcgtcgccgcacggccgccccgcgccgccgcgcgcgacgccgagccggtcaggccactttcgacgctccccgagagcagcattgggctgtacgacccctcgcgcgagcgcgactcgtgcggcgttggtttcgtcgccgagctgtcgggcgattacaagcgcgcgacggtaggtggtagctctgcaggttctctcttctgaacatcacctttgcgatatcgatctgatttcacttctctgcaggtcaatgacgccctcgagatgcttgagagaatggcgcaccgtggtgcctgcggctgtgagaagaacactggcgatggtgccggcatccttgtggctctaccgcataactttttcagagaggcgagctagaaactcaataaaattttaaggcaaaggcagctcgttttaacagttaattcatcttagctgttaccgtttgtactcctgcaggtgacaaaggatgctgggtttgagctaccgcagccaggcgagtatgctgtcggtatggtcttcctgccaatcgatgagaagcgccgtgagcggagcaaagctgagtttcagaaggttagttgttttcatttcttttgttttttcaattcatggccgtgatatttacactaatgttttctgttactttcatttatccaggtagcggaatcgctgggacatgtaatacttgggtggcgccgggttcccactgacaactcagacttaggtgaatctgcgctccagactgagccagttattgagcaggttttcctcaccaaaagttcaagttcggaggctgattttgagcagcaggtcattccacgagtttacattttgaatttatgaatgcgtatgtagtagactgtgtatttaactcatttgtaatgaattattacagttgtatatcctgaggaggctctcgattctatctatccgtgcagctctgaatctccgtcgtggaggaaagagggacttctacatgtgttctctctcctcaaggtacttcttcctcttttctctcttcttccatatttcaagttctctatgtttgattgagttgaaggatggaaaggatgatgattcccaaatcccaatcaagtacacatttcattttttggaagagatcatcagcaaatattttccaaatttcatgtttcctgtgtttgattacgttgaaggatgaaagcgatgatgatacccaaatcccaatcaagttcacatttcttttttttttttggggggggggatcatcagcaaatattttctatttcaaatgggactaaagaaagaaaaaacaatgagctctctcttaaggatcctgtagtgtaataactttctaattgtgttctattcatgtgagtaattcaatgtttgctttcttgtgatttccaggactattgtctacaagggccagcttaagccatgccaacttaaggggtactactatgcagatctaggtcatgaaaacttcacaagttatatggctctggtaaatacaataccttgatcctcttatacaaaaaaagtcatgaccatagtcggcggatgggaaccaataatagcaaggcagttgtaagatcaagactcctgtgcaggcatcaaactttgaattgtcttaccatcactgctctattcatatgatatttcagtcctggttcttgatgcctttaagtgaagtattagaaatctttattagttgatactcgataaccatgttgcagagtccagctgcagttctgctatggccgactgctatgccgactcttctggatgtgacctccaattaggtggtgggaagaaattgtgtttggtttgaggtagcttagggcttccaactgttttgcatgaaattctatgcaactgatgcttcagttttttcagtgtgttggtgtttcatttagaagttttgttcaacattgtaaaattacaagagttgagtataatacagttactaagtttcatgcatccaaacaggttcactcaaggttctccacgaacaccttccccagctgggaccgtgcacagccgatgcgtgtattaggtcataatggagagatcaataccctcaaagggaacaagaattggtaatcttgctttttttttttggaatgctccatacaatgtccatttctaggttgtatgtaatcatctccacatggctatgccatttttgtttatgattcttggttttataactgcttttgcatgcatggcaggatgaaagcacgagaaggtctcttagagtgtgagaagcttggcctaacaaaggatcagttttcaaaaattctaccaattgtggatgctacctcgtctgattcaggtaagagctaattgtttcatgcagtgaaacatcaagtacacttagaaaatgggattttccttatttttagagatttgttaattagatagaatcatttcaattctaggtgctttcgatggtgttcttgaacttcttatccgtggtggaagaagcctgccagaagctgtgatgatgatgatacctgaggcatggcagaacgatgtgaacatggaacctgagaagaaagctctctatgagttcttgtctgcccttatggagccttgggatggacctgctctaatatcttgtaagaagatacggaagaccttttccttcctgatcacacatttcccatgtactatttgtggttactttgctttcatctgcagttactgatggccgttaccttggagccaccctggatcgcaatgggttgaggcctggtcgattttatgtgacacacagtggacgtgtagtcatgggaagtgaagttggtgttgttgatgttccttccaaagatgtattgagaaagggtagactaaaccctggaatgatgctgttggttgattttgagaaccatactgtagtggatgatgaagcattgaaggcacagtactcgaaagctcacccatatggggagtggctcaagagacaaaaaatatacctcaaagacattgtagaatctgtgccagaaactgagagagttgctcctggaatttctggttcactcacagtaagtctgttacagtgttttaacattttattttattttttcactggctacaattttagctggtatttatgagaatttggttacactataattacttatctttttttttacactttggtgtagcaaaagaatgagaaaaaggaacatgcaggcgtcaatgggattgtgactccactaaaagcctttgggtaagcaaggtttcgactttgttgactatctttgctgttttgagttcctttttggtttatttatcaaatttatttttactgcagatacacagttgaagcccttgaaatgctgcttctcccgatggctaaagatggagttgaagctcttggatccatgggaaatgacacacccttggcagtcatgtcaaacagagagaagttgacttttgagtacttcaaacagatgtttgcacaagttacaaacccgccaatcgacccaattagggagaaaattgttacatctatggagtgtatgattgggccagaaggtgacttgttggaaacaactgaaaagcaatgcaaccgccttgcacttgagggtcctttggtgtcgattgatgaaatggaggctattaagaagatgaactaccgtggttggcgaagcaaggtgctcgacataacttatccaaagaagtctggaaggaagggcttggaagaaactttggacagaatttgcacagaagctcggggagctataaagaagggctacactgttttagttctctcagatagaggtcagtgaaatattcaatatatactactgatgtttcattactcattactcataattttgtaatcattcctgcggtagtcaaacgcattcaacaaatttatttttatttaaatgtagctccaagcatataattttggaatataataggtcgaatattatcaattaagtaggtgtagcgctgttattatcaacaaagttataacattcgtttaccttatgcatttccgtgtctacgacattcttcaacatttgacctttctcgcatgaaacttactgttttgtttaaattcttgatgcaggattttcctcagaccgtgttgctgtcagttcgctcttagcagttggcgcggtacatcagcatcttgtggccaatcttgagaggacgcgcgtaggtttgttggtggagtctgctgaacctcgtgaagtgcaccacttctgcacccttgttgggtttggtgctgatgctgtatgcccttatttggctatcgaagcaatttggtgcttgcagaatgatgggaagattcctcctaatggtgatgggaaaccctactcaaaggaagaacttgtcaagaaatatttctatgcttctaactatggaatgatgaaagttcttgcaaagatgggaatttccacccttgcatcttacaaaggtgcacagatttttgaagctcttggcctttcctctgaagtcatccgtaagtgttttgatggtacacctagccgaattgaaggcgccacttttgaaatgcttgcacgagatgctctacgtcttcatgagttggcatttccatcaagagcacctccaccaggaagtgcagatgcaaaggcccttcccaatccaggggactaccactggaggaaaaatggtgaagtccacctcaatgatccccttgcaatggcaaaactacaagaagctgctagagtaaacagccgggcagcatacaaagaatattctaggcgtattcaggagctcaacaaaacctgcaacctgcgtggtatgcttaaatttaaagacactgctgacatgatttctgtggacgaggttgaacctgcaagtgagatcgttaaacgctttgttactggtgcaatgagttatggatccatttctttggaagcacatactgcccttgctatggccatgaacaaacttggagggaaatctaatacaggtacactgaaatactatgtagcatttgtccctttgttgctaccatttgcacaatctgcagtaagaacactttatggaattacctttcaaaacaagccttctgttctgagccactattttagacatacttgtacctacaaatgaacttattttgattctatcaaacaaaaaggtatttactgcatttcactcaaagaaacttatacggtaccttgctattttttttaaaaaatcttctgttggtgtggagagtgccttctgaagacaaaatatcactatttttagtgggattgagttttttccttgctatacagaaaattctttcctgcaagaagcatattgcactatttgagactttattttttgtgttttattttatttaactgtttctttcttgtttaacatatttctagaacttaatattacttttattcccaggtctaaaatatctccttttacccttttgctattttgagtagaatccataacctctaaaccattatgcactaactctaatacatctgtgaaggtgagggaggggaacagccttctcgtatggaaccacttgctaatggttcaatgaatccaaaaagaagtgcaatcaagcaagttgccagtggaagatttggagtttcaagctattatctgactaacgctgatgaactgcagataaaaatggctcaggtacttgtcaacattgtgcactacaaaatcattaaaatgattgcagcagtctattgaaagcacctaccatgttgcagaaatttaccttttgttataacttctttatgtatgtagggtgctaagcctggtgaaggtggtgagcttccaggccacaaggttattggtgacattgcggttacaagacactctactgctggtgtaggactgattagcccacctcctcaccatgacatatattctattgaggatcttgcacaacttatccacgaccttaaggtaacttaatgtgatactgcattgctatttcttgaaaccaagcgatttgttgttatttttgtatagttgttagtactagatttatttctgagatatcataccaactcatgatcgctcatttgccatgcaacattttacaattgaacttgaacacatgcatgcaatttgcaaatgttgcttcctgatatatggtgacattcttgttgcttgtactcttcagaattcaaatcctagagctcgcataagcgtcaagctagtttctgaggctggtgtaggagttgttgctagtggtgttgtaaaaggacatgcagaccatgtccttatatctggccatgatggagggacgggagcttctaggtggacaggtattaaaaatgctggccttccatgggaacttggattggctgagacacatcaaactctagtggcaaatgggcttcgtggccgagctattctgcaaactgacgggcagttaaaaactggcaaagatgtagctgttgcttgcttacttggcgcagaagaatttggtttcagtactgctccgttgatcacacttggttgcatcatgatgcggaaatgtcataccaacacttgccctgttggtatagctactcaagatccagtgctacgagaaaagtttgctggagaaccagagcatgttatcaacttcttcttcatgcttgctgaggagctaagagaaatcatgtctcagcttggcttccgtaccattactgaaatggttgggcgctctgacatgcttgaggttgatccagaagtagtgaagagcaacgagaaacttgagaacattgatctctcattgattttgaaaccagctgcagagattcgccctggggctgctcagtactgtgttgaaaagcaagatcatggtcttgacatggcattagataacaaactcatagctttatcaaaagctgcacttgagaaggaagttcgtgttttcattgagactccaatccagaatactaaccgagcagtaggcactatgcttagtcatgaagtcacaaagcgttatcacatgaagggattacctgcaggtacgattcatgtgaagctcactggaagtgctggtcaaagtcttggcgcttttctctgtcctggaatcacccttgagcttgaaggagacagcaatgattatgttggcaaaggattgtctggcggaaaaattgttgtctacccaccaagagatagtacatttattccagaagacaatattgtaattggtaatgtggctctatatggtgctactataggagaggcatatttcaatggaatggctgcagaaaggttttgcgtgcgcaattcaggtgctcaagctgtggttgaaggaattggtgatcatgggtgtgagtacatgacagggggtactgtggttatccttggtaaaacaggaagaaactttgctgctgggatgagtggaggcattgcttatgtttatgatattgatgggaaattcagcgtccgctgtaaccatgagttagttgatctctatcatgtggaggaagaggaagacattaccacattgaaaatgatgatagaacaacatcgacttaacactgggagtgttgttgctagagatatactctctaattttgatactcttcttccaaaatttgtcaaggtattcccaagagattataagagggttttggacaatatgaaggctgaaaaggctgctgctaagcttgcaaaggaaccaaagatttcaaatggtgtttctgtaaccactaaggtaggggatattctgaattactaagtctattttatttttgaactcattaaaatttcacgatggacaaatagcttcaagtgagaaaaatgaaaaaaagagagaaacttttgaatttacattgattatatatgaacgtgtattccatatctataatattaccttagaaatagcaattgtatatactaccattgctctgtaatattgttggcttaattagatacttaaatttacagaaagtgcaaccggagcaatcaacaaaccgaccaacacgtgtttccaatgccaaaaagtaccgaggtttcatttcatatgagcgagagagtatttcttaccgggatccaaatgagcgtgtaaaagattggaaggaagttgcaattgaatcagtgccagggccactactgaacacacagtctgctcgttgtatggattgtggaactcctttctgtcatcaggtaatattcagctttgtccccctttcattggtattatttttgttggattgttgttaggttaaggttattgttttcaatttatcttactgttgaattcaaggacaatgatgagtaattttacatcttagacagtaaaaagttgccactatttaggcattgataatacttttatgataacttaatcgtagatattgtttgtcttaacttgtccagaaaactgctggcttgttgccttttttttttcccaaaatttgttactaatatacctcctaatcatggcttgtggtaatatctctatgtagtgagtacacattaatgtattgtttatccattgaatgaatattgtgattcttttcatggtgcttattataaacttcaatattgttgcaggaaagctcaggtgctggctgtcctcttggaaataagattccagagttcaatgaactggttcaccagaacagatggcgtgaagcactagatcgtctgcttgagacgaacaacttccctgaatttactggaagagtatgccctgctccctgtgagggatcatgtgttcttggcattattgaaaatccagtatctatcaaaagcatagaatgtgcgatcatagacaaaggttttgaagagggatggatggtaccgcggcctccacttcaaagaacagggtattcttttgcgatgtcatttttttttgtctaatttccatcacgcttttagttgttatttcattacaaggtaacatctgagaagctattaaaatatgaactccttgttttgcagaaagaaggttgccatcattggaagtggtccggctggtttggctgctgcagatcaactaaacaaaatgggccattttgttactgtgtttgaacgtgctgatcgtattggtggtctgatgatgtatggagtgccaaacatgaagacagacaagattgaaattgtgcaacgccgtgtcaatttaatggcagaagagggcattacatttgtagtgaacgctaatgtaggcagtgatcctttgtattcaattgagcgcctccgttctgagaatgatgcagtcattttggcttgtggagctactaaaccaaggtaacagatctaaaatgtcgaatcgatcatttctatcttaccatgctttactggtgatggtagattgttaagttcatgagagctatcagcaaaagtaaaccatatgcttgtattatgagttgacatttaaatgatattttgttcaacagggatctaggtattcctggacgcgagttatcaggagttcattttgccatggagttcctccatgcaaatacgaaaagtttacttgacagcaacttggaggatggtagatacatatctgccaaggggaaaaaggttgtggttattggtggtggtgacacaggcacagattgcattggtacatctattcggcatggttgcaccagcattgtaaaccttgaacttcttaccaaaccaccaagcaagagagcagctgataacccatggccacaggtaaatatatgtccctaaatgtgatagattagctggcttggctaaccttgcaggaagctttcatacaaaacaaggcacatctgtaaaatagtttcttatcatggccttggatctgttttgctcctatcatttcctattgggaatatgttcttatgttttgtttctacttgtagtggcctagaatcttccgtgttgactatgggcaccaggaagcatctagtaagtttggaaatgacccaagaacttacgaagtcctgaccaagcgttttattggtgatgaaaatggaaacgtgaaggcccttgaggtggtccgggtcaagtgggagaaagtcgatgggagattccagttcaaagaaattgaaggctcaaacgagaccattgaggctgatcttgtcctcctagctatggggttcctaggccctgaagcggttagttttcccccatcaccaaaagcggttagttatactgttgggtaaggttggtgagaatgttcattaaataataacaagctgtttccctttctgcagactattgctgagaaactaggtttggagaaagacaaccggtctaacttcaaagctcaatttggaaactttgcaaccagtgtggatggcatttttgctgccggggactgcagacgtggacaatcacttgttgtttgggccatcaccgaggggcggcaagctgctgcagctgtcgacaagtacttgtcaaggaatgaacaagatgccgcagaggacataaccccctcgggtgcaggttttgtgcagcctgttgcagcataaatgaaacaggcaaacttttcaagaccagtgcaatctaaattaggatcaacgtttttagtctttgatcacagcaagttgtctttgaaagataaggccgggctcaatagggaaaagagaagagccttcttatattttggtagataaacaattggaaattttggtgtgttctgcttgttacttttccagtaaaatgatttgcatggtgaaatgccgttttgtaatctgaataataatgtacagttgttttggtttaattaatagatgtaaatttgtctattaatcttgccatttagtttcttgtttctgtgcaactgctattgttgttcgaattgtcgagctggtatacctggtgaacatgccatgaaagtgtgaaatttgttgcactcgattggatttgttgtaagtactgagttgtgtttggcatatttgaacacttgcaacgagaacaaaaatattgcacaatgcatttacaaacactagttgcagcaacacaacggaaacgggacagtacaacttggccatcaggagtaaatgtcaccacaataatagaggggaccaattcaacacacaatttagcatccattataatttacaagtgtttaatttactttatattttatatataagtaaatgcctttcgtggccaacacaatgcatcgagacttcggcgtggatgaaatagtaaaagtgacacggatcttgaatataccttggtgacgatatagatccaaatcaaccttagctccaagagtgtgtgtgtgtgtgtatgtggtgaaatccgtctcgtaggtgaattgaacgggttttggaaggatttcacactaaatctgattagagtaagggcggagctagaaattttatgaagctggacaagttaataaaaattatataaaaccactacccacttatcaaatgtttatatgccgattttactactaaattgaacacatgaaagtttttcctaataaaatcatagtttaacatgcatgtaaattttcaatagttgaaaaatctgatagtttataatataaacgaacaattcatatggctagcacttaagtcaaccatatcagccactatgaagcatgcttgctccaaaggcttataagttataattagtaagagcttagcctgctaactactcccttcatcccattatcccttcatcccgttatataaacgattttggagggatgtgccgtatccaatgctacgaatctgaacaaaaatatgtcaagattcataatattagaatatttcacatttctctaaaatcgctt

SEQ ID NO: 800 - DNA, 12520 bp, Oryza sativa
gataaagcatgacaggaagctaagactgcttgttacggcttgatctcattctttataagttcaacaactctgatgctttagtttcttgattgtcctcttggatgccagagtttggagtagatgttgtttatagtttttgttgtatcttgtattatacctcccatatatttgtaaaatatggaccacgaatcatgtaacaaagactaggaagacgcgaggtttaatttcccctgaactgtgtacttgatctagcatggtgagtttggtcattggcagaagttgtatgatcaattttgtcaggtcgagatgaattaacatggcatggacagactttgatacccctgtttactcgttgctaaggtgccctaatgaatggaagttggtcttggtcttcttcagggcaatttatactttataagccccttactagaaaaatttagagaacttaaaaaatccataaaccccctctgccacatagtcctccaagattttagttcaaattataatatgtgagcgagcctgcttccatttcagttcaaactataatttatagctggagctagagactaacagttttatgggtcttttagggtggagtggagctatggagcagaaaaacccagctccaccctcgtagttcattttctaggagtagctctgccaactccactccaaaaaaaatggatttggaccgtttggcacagcttcggctctaggtaagttgaagttgggagctagaaacagatctttagctttacataaaaagggagtagaacctcttggattacataaaaagagagtagaacctcttggaaacagatactatatatacattactacatataattgtttctgggaagtagctggttgttagtcacgttaatctagaaacactggtttttctgcttctaatttcagtttattttatttttttaattctacaactacatattcaaatattctgagaataaatgtaatattcagaaactccaccaccgctacctgagaatggaagcttgtccggtgaatggcgctaccgcagtccgcactggcccagccagcgcgccaaacacagattcacataaaccaaaggcgccaaacacgatcgaaccgagcactcaaaaagcactaaaaaaatttggtgaaaaggaacgacgagccggcgacgagagctccagaaccctagccatggcgggagaggcagggggagacccccgagcgtggcttgccgtcgacgagacggcggcggccttcctctcccgctccctctcggcgcggccccccatcctcctcccgccgccgctccaccgcgctccgctccgcccgggcaacgtcgtcgagatcgctggcccgtccaactccggcaagtcccagctgcttctcacggtaagagaatccaaagctttctccgcctaaatggttagcgaacataaggcatttagccctcacttagtcgtcctttctaccagaacttccctttagcaaatgtcttaagaatttcagtatctgctgcaagctttgatcgaccccaatttgttatgaagctaatgatagtgcatatctgcattcataatctcaatatgggattcaacacaacttatgataagtgaaagaaaaagagcaatgaccgaatgacactatgctgtgcgggagttttagaaaatcggagatatttcgttaaattactgctgtttctgggaacacgggacataggagtaatttacaaagagggggggggggggggttgggagggggattaccttgtgtgtttggtgaaaggtactagtttagaatgctataatgcttcatgcttcataaatcataagtggataaactcaatgccattttgacacctatatatttttttcaatgaagcaatgtaaaagttaagtgtgatctgctcagtcactgagttgttattactattgtaggctgcagtacaatgcatattaccgaaggagtggaagggtacctattttgggggcctgggtaaagtggtcatgtacttggatctggactgccgatttgatgtgctgcggctggctcaaattctgagaaatcgcattggagagtgctgtggtacagttttgcttgcattgtgaactttgcattattaagtcatgcatcctatccaacttagagcatgttgaacatgatgcatgcttttatgggtgcatagagctgactgattaactgtgctgtcttttgttcataatgttgtagttaggaattgatttgtgtaaatcttttataggcttaggctccctccactattctacacctacatacccctcaattcttagtggagaataactgtgccataaatagacaaattttgattcttattgtttccaatcctctgtaattacaggctccacaaatccaacaaatgaagaatttgcaaaggatggcgctacaaatagtttttccgaaaacacgctattttctgagtgcatgaagcgtttcttgtatgcccgttgttacaatagttcagattttatagcagctttgcaggcaagttttatctgacaatatgtttatacacgggcacattagcatcctcatttgtgtcctccttttctttaactgatggctgacatgaaatatgtaaaagtatataaacagggggctatattaaattatgcctgaccctttgaaccactggatgaacaagttggtttctttaggttgtatacttgtataattgctgagtatgcaaaaggttccgttgttccttgtttagatacagaagagtatagggctatcatgtcagtttgcctttctggtaccaaattaaccaactgatcatttgctcaggtgttatgttctgacagttgacttaggcatttgcagtaacatttcttgaatattcataatggtttgacaaattttttttgtcccatagaagacaaaaaaaaaaaacttttgccactcatgtccaacaaaattacttcattcactcatggacatctgttgatttctatcgtaatatatttgtaaaactcaataaatgtataatattatgtaagtaccttttgatcaatcattaatctcgacttatggttttcatgtatctaaatatttaaaaatatattgatcctgaaagttttgaaaacacatagagaatactgagttcttgctcattctctggaatcaccttatatttgtcatggacctaagcttaatctttatgagataatcataagatagctgtattattgaaaaacagtcagaaccatgaaatgcttttgtagaatgaattacaaagaaggcaacacattctgttccccttttatttttgtaacagtctaggagttatgccatgtgtagataagttatatcttaatgcgtatataagatacacgttttgttattataactggttgttcattttacagaatatacattcccaatcaccagcaaagagcgaagttcttggtgttggcatatatttccttatgatagacaggtattccttttcaaggtttcctttgtctttctatttgttatggtcacacttattgcatcttttggtctgccgcttgtattgaagttgtggctactttctcaaaatgctgcatcattcaaatttttttaatggtattctgcattgttctcacataaccatttggccctccggacttttcttctgtactttttattcttgtagtaactgctaaacattttgtaacattatcccttttccagcattggctcattctactggatggatcgtgattctcaacctatcacagagagtaaagggtgattgcgaaaaacatttcatgcagtattagcttcatatcctcctgattttgtcatgtgcatatatcacaataacaattagcatagatgttttaattaattattgtctcttctacacttgtaaacatgtgaataaaacaggtttaacttaatacttcatctgctaaagggtaggatggtacaatactacagtacatagaaagtatgcatcctcttgctatctcgcatacataaattaaaatagaagagttacagcatgttacacagtcacacacactctgaatgcaatgggtagtcactatcacttaataattatcattcaaaagaaaataaatgctacttgcattttcaactaatattagatgcatcattattgcatatgcaacatttacacaaaaaacatcatgaaatacagtatggaatacacatgtacttgtaatgatagtgctcagtggcacagttcaaactacaaaatattactacaacttaggtgagaataactaggtatgtttcaattgcagtgtattgcttaggaaagaggattaaaatgcgtacttgtgcatgggaacactgtacaaaaacatgttagactttgttggaaacatttacaaaattttccaacctgaaagtatccagcattttggattacaattacttctgccaattctgtaactctatctcactagtatctctttgcttttatgctaaccctttcacaactattcatgcaggagaactctatcactgcagagtatgacagaaacagttgtccaaaaattacgcaattttttgcaacttcaacctgttttggtgatggccaccaaggcacccatatatggcgaaggattcactggaaatgatttccaaaggtaatatcactaccagcatggaccctttttactgttatctgatggatgcaaatattttacctctcaaaaggatgattaaggtgtgataaggtgattcattcaggaggaaatggcacaactaattgatcactctgatttgttttacatatttttgccaccatgcatttgctctgtttaaaatcaacatgcttccttttgttgcatatgtcaagttcttttactcaggatcatgatcttcccatgtgaagaagctgaaaacctgaaggatactggctttctttttgggtatttaggggtacttcaaaacagatgttagaggattcaacaatgagatgcataggtcaggaggaagagaaaaacatctcataccgtgaattcatgccgtcagtatggcaggtccgtgatctttattcattaaaatgttaattctgatttcgtacaaagtattacagaacatgctaacagtaagcttcaatcgccatttgatttgtttgttgtatgcatatatacattgccgtgtggccagtatctatttatgaatcataaccacataactgtctaaaggatttctgaatttgtgttcttgcagtcatttgttacacacaggataaagctacaagatttaggttggtaaatggtctttttatgtggttcatgattttgtccttattttcattgcatatgtttatttgatttttacaggacaagaagcagaacttttctctggtcaggaaaacaaggagctacctttacgtacttctgagtggatgcagccttccctcaacacaaaggataagttttctattacagatgtaagctacttatattttttttctttttgtaagctacttgttacctttctttctgttatcaatgtactatttttttttacagtcccatgcatattttgatttagacacgtccttttccatgatcaggatggtgttattcttatccactgaaggttatcagggtttccgctgatgtacatatccaacttcctggctggattattgtaatctgtggaaaaacctgtaagagatgctaatactctgataacacctatgactcagaacccttaggtgagtgcagagtgaacctccctgcttttacagaataaatgatcttaaattttctcaaactaagaagctaatcaaaccaactagcaaagaattcacacgtctcttacatgaaagtcattaaatctatgataaatcgaatgacgcagagaaaagaggctttgtgtttgtactgcagaaaatatatctagataactgcagaaaagaggcttgtccatggtctctgttagagaactggctgtagtttattgggttgttttatcttcaaatatatctagcaaataatctgacttaagtaaaacatttctaaggttaattgaaattttaggaggcgtctaaaacaattgcagtactatacataccgaggtatattgtttctcaccatgagcccctgatgcacttttctggatcacagtacaaggtggtctgtttttttatgatacttgaaaagactattcaacgatgataaaataactcatgtttaatttaattactgcaaatttttcaccattatacttgttttaatttgttagaatgcaactgtcatattattttgaagtttactgtgttttctcacttcccttgatgcacagcttctgttagtcgatcttactttgctctaatatattattttccatactaaagcccaaacataaactcacaaaatatcatcaatgaagcaatagcagaaaaatcatgccatttataatacatgaatctgacagtgaagcaaaatgatcaggtcaccgtttgtcttggcttttgatgtttggcacagcatagttggacttggaactctgtattgattgctgggaaaaagcaagccaagcttctttatctggactaatggctgcattatactaatgtcacgcaagtttgactattttctgattttttaaaacacttctatttctgcgtggccattaggaagtggatgcctgaaaacattagatgggggaattaaaagatataatgcttcagagtcaccaatttatcaggtaattccttcatagccgtgcggcagctgcagctcacattatgcgagctgctttctctgttagatataacttatgtagattaaggctaatctcagtgccagaaaatgaggggtttaggtttgaggaatatgagaatatttatgtagattggacataaaatacgacctagatttacttgctagtttattcaaggccagctcaaattcatgaaggtttggaaattagttctgattgtgcttatgctcttttttttttccctgttactagatggcttgtcttatctgtcacattgtcaagcactatgagaactttgtctaacatcacatttgatgtgaatctttgtgtgcctgctacatatggatttgttcttattttgtgagtttctacttgagttcctagctgtcatttttattctttttttttgttccagctagtgcttgtcgctcactcatagcaagatacgcacccttcttggtgatccctaagtatacccaaacactttattgcgttattgtagttggtatagtcatcttcttgtccatgctaggtcgctagcattgtgctttttccacttctttttatcaattgttgttcgtcaatcgagcatagcagctgatgtactagtttaacacaaactatacaattccacggatgaaggtgaaatggaagatgttaacggcaatggttactttctgccggccttgcaattgacgagttggtcctccaaatatgattgtagatgtcgcttttgtgttttatgtaatcatatgtgcaaatgatctacctgagatgatgttgactaatgttaatttagatgataatggtatattcttgcagacgagttctttccgacgcccctgatacatatctgttgtcttgtacagagtacagactttccatggcggcatgagtgtctcgtggtgtcgtgcagtagccctgaactctttctgaatcacgaactggataaagcttgattgagagagttggcaaggttgctgttcacattaatctgtgacccaaggtgtaaacaaagcttttggaatgcaccatggaggtcagggttctccaaacccttttaatctcgtggaatgaaaagcaatggaggactcatatttgctgtagctttcgaccgtggagctcacagaatcctcgtgcagaactgggtgtagcactcactacactccatcccgtgggagcttttggtacgacaaagtttgcagtcatcaaagtggcagtgtaaaatggtgggagacttggggtgacgaccttgtaatcttgctggtgaatctccccttctaaaatcctgtagcagatgtccaagaatattcaaccaactgctgaaaagtgaaaacgaccttggatcccatattctcattgtattggagaggtcagcaagctgctagtgctgcaatatggaagcaggactggaggagcagaggcgatgcgtttcacccaatgcactacgaggtcagacagccatctgctgccacgtgtactgctacggtcagccgtatgcgaagcaaacaacaacccactactggacagcaaaaggcccagtctacttgccaatcattcgttgctcggccggttctgtacttctgacgatcgcaggtacaactcgtcggcctgaaatcctgtatgcttctttacataggatttttttcccctttatcatgcattaatcctctctcatttgatacaaaatcgtgaaagacttgacacttcgataaactcagaatagaggatccgaatggaaatttactccaattttttttaaaaaaattaaaaataaaatagggcagtggctacctaggacaagagcatccagccaggccgaggaaaatcctttaccagccaagccaaaacattcacaagtccagaagcacacaagactcgatcactcgagtctctacgtgaatcttagcggaagataagggagcatcagtacagcccagccaataggacgcgttctcctccaatcccaaagccgcgcgcttggattcttccctcgccgatctcgcgagccccagctgtgctcgttcatcactaggctctccctcgtgtcactcaccattctattcgctctcgccgccagctgcctcgccgcctcaccctatatatatatctcgccgtaagttccccatagcttcaccatcgccgtgcaccgaccgaccgatctccggccagccggccagccagccagccaccgtagtcgatcgtcgtcgagagagccgctactacgtacgtacgcacgccgcgatgtcgggggacgcgttcaacatgtcggtggcgtaccagccgtcggggatggcggtgccggagtggctgaacaagggcgacaacgcgtggcagatgatctcggcgacgctggtggggatgcagagcgtgccggggctggtgatcctgtacggcagcatcgtgaagaagaagtgggcggtgaactcggcgttcatggcgctctacgccttcgccgccgtgtggctgtgctgggtcacctggggctacaacatgtcgttcggccacaagctcctcccgttctggggcaaggcgcggccggcgctgggccagagcttcctcctcgcccaggccgtgctcccgcagacgacgcagttctacaagggcggcggcggcgccgacgccgtggtggagacgccatgggtgaacccgctctacccgatggccaccatggtgtacttccagtgcgtgttcgccgccatcacgctcatcctcctcgccggctcgctgctggggcggatgaacatcaaggcgtggatgctgttcgtcccgctctggctcaccttctcctacaccgtcggcgccttctcgctgtggggcggcggcttcctcttccactggggggtcatggactactccggcggctacgtcatccacctctcgtcgggtgtcgccggcttcaccgcggcgtactgggtggggcccaggtcgaccaaggacagggagaggttcccgccaaacaacgtgctgctcatgctcaccggcgccggcatactgtggatggggtgggcggggttcaacggcggcgacccgtactccgccaacatcgactcctcgctcgccgtgctcaacaccaacatctgcgccgccaccagcctcctcgtctggacttgcctcgacgtcatcttcttcaagaagccgtccgtcatcggcgccgtccagggcatgatcaccggcctcgtctgcatcactcccggcgcaggtaccatcacactatatatgcatgctcctcatcgcttgcaccagtgcaccgcccatgcttaatctacacacagtacactaggtgatcttcgatcgtttatactgaaaatgaattttgggcgaaaaaaaaacattagacatgactaattgagttttatacttattattactttctccttttcataatataaatcgttttggatgtttttttaaaaaaaatcttttaagtttgaataagtttataaaataatttagcaaacatctacaaaatcattagtttcactaaatatagcattagatatattttaataatacatttgttttgtattgaaaaatattattatattttttagagtgaatttcacctgacccatatattatggtcataagttgcacaaaatcacaaagtttcacaaaaccacactcttgattattttgattttggtctaccatacttttgagttctataatcaaatttcaagtttatgagttattatctatcatataaatgttacatctatgttagttaaactttttaaaattttgatacaggagtttgtcaatttggttaatggcgtagttttgtgaaactttagaactataatacccggggttacgttccacgtgctatggttttgcgtaaattggtccataatagatgatgctttataaaatttactctattttttgataaactcgattaaactttaagaagtttaactaggaaaaggtcatatgaaacggatggagtataaacttgaaaatagatttatctgaaattttaaaccgagttagtaaaatctgtatctggggctgggcgtaactgatccgtcttgaacggcgtctgcatatgcatggtcgatcaggcctggtgcagggttgggcggcgatcgtgatgggcatcctctccggcagcatcccgtggttcacgatgatggtggtgcacaagcggtcgcgcctcctgcagcaggtggacgacaccctgggcgtcttccacacccacgccgtcgccggattcctcggcggcgccaccacgggcctcttcgccgagcccgtcctctgctccctcttcctccccgtcaccaactcccgcggcgccttctaccccggccgcggcggcggcctccagttcgtccgccaggtggccggcgccctcttcatcatctgctggaacgtggtggtcaccagcctcgtctgcctcgccgtccgcgccgtggttcccctccggatgcccgaggaggagctcgccatcggcgacgacgccgtgcacggggaggaggcgtacgcgctgtggggcgacggcgagaagtacgactccaccaagcacggatggtactccgacaacaacgacacgcaccacaacaacaacaaggccgcgcccagcggcgtcacgcagaacgtctgatgatacgtgtcggtttttttttcttttcctttcctttttggggttgtatacgttacgaaatgctgcggtttcctgtcgtggaataatgtggtggtggttctgaaacgggtttcttcttcgggatgctctggtttgatgatttcgaccattcgagatttaatacagcggctactttcttttctctgtcacttgcaattgagtttgttttgtctctgtaattttgaactgagtttgtttctattccttccatgcccttgcacgtgttactaccacgtcccaaaatataaatagcatccggattcaaatttgtccaaatataactatgtctaggatgagtatagtcatacaactttcaaaacaaaatttctctaaaatcatttaatgaattataatgcacatttaaataattataatgtaacttgtacataagatgcacaaaatttttgaaatatttgcgatggtccaagtggctagtgcatacagtgtgtgatcaatagttcctgagtttgattccgtgtgactgcgtgaatgtgtcaaagaaatttctagtgaatttgttccgaattaaatttaaaaatatattgttcaatcatttttttaggaatattcgggatgcaaaaactttttagaaatataccgtcgatctcgcacaaccgttgcgcgaaaatgacgtggacgtgacgtcgccgacggtatcgcgcggtgaaagtgcgagaccgcatggtctcgcggaatggaatagcgagaccgtttggtgataccagtgccatgctgaattaattagtgattaattgtcatgattagcgattaatttaattccaagttgaattaactaaggggctgttcaaattgatgttattttaaaccatactatttttttaaagttactaaagatatacatacaattttttttgcaaacttttagtaaatacatgagaaatcatactaaaattttgttaaaattgaatattttgtctataacctgaacagtccctaagttcgattccgtgtgactgcgtgagcgtgtcaaagaaatttctagtgaacttgtttcctcccacgccagaacgaatgtttgagcaattcggatcctctgctttagaggtactaatgcagaggatgaacagtaccacgcattagaatcactatggaccgtcggatcaagagtgaaaggaccagattgtgtgc

SEQ ID NO: 801 - DNA, 6311 bp, Oryza sativa
cagccttgctattattcccccttttcagaagtgtggtgcttctgagctgaagacgaagttagaagaccaaggctcagaccccagttgagttttgcctgtggagtggagctgaagccccgctaggatcgccttttttccgctgctgctgcttttgtttcggtgtgaggactaagtgcctcttctgtaagtattttgcgctttatttacgtttggaactgtttattacttgtcgttttgtgtaccctggctggtcctggacagggatttaatacacaaaatagtctggaaatttgggctaaatttctgggcgtgacatccaactaccgtgacggtggcaagcattcgtcgacacccccctacctcgatggacctcaacaatggtggttgtcgatgaggcaagaagatgacaaccgctggcttgggctgctgcctcctcttcatctttgccatgggcccatggtcgttggatccatagagatcccattctcgattggctgccttgccgatattcccaaggtatcctccattgaactcctccaaatcccactacccagctcaccaagcttcttcctctccaccacccccaagacactcttctcctcctcattacatgtccccatccgctccctcttcaccaacgtcgtgcccaccacgtctcgtagttgacctcaaccttgagaccatgatcctcctcgtcgatttggatggacgaggagctcgttattggtgcgtactggcctgcatcctgcaggagaagagtggaagagagagagaggggcaataagtgtagggatatttttttcctaatatgtgagttccacattatttaatttttttctctaattataagtgtgacgtagatgtcacatcacctaacactgatgtcaatattgaggaattagctgtagaaactcgataattcgataggggacgccaattggactttgtaaaaagaaaagaaagatagagagggaaagagaacggaacagagcggagtaggaaacacacacgcgtctcttggcgttgcgttgcgtgcgtacttattcttgtcgcggcgtgccatttccggcggggcggtgcactgcattattgttgcctcgctcgctcgatcgatcccctctcctctccaaatcccatccccaaatcccgaatcctccatcgagatcgatcgacgtcgagcggagcgaaggggggatatgggcggcgtggcggcgggcaccaggtggatccaccacgtccggcggctcagcgccgccaaggtgtcggcggacgccctggagcgcggccagagccgggtcatcgacgcctccctcaccctcatccgcgagcgcgccaagctcaaggtcctctctctctctctctccccacccatttcatcttcatcctgctttgcagcgatcctctttctccaggttccccttctttttttaaaaagctgcatattcctttcggttcgatttcaccccctttttcttttatttatttatattcgcccagttaatgggtaatcatgtttagtgtcagtatcacccggtctttttcttttcttttcttttccttttactagtggtagcatgtgctctccctttgttaacattgtatcctgctactgctaatcgattagttaattatacaccattctgttgttctcacacttgctctctctctctctctctctctctctctctgcacctgtgcacccaaaaatttttttttttttgctacttaactttactgacttactaccagtaataataatctcttaatgcaacaaccataatatagcacttgcgttcagatagggggcatccttacaacactactctgatgtcgcatttgattctgaaacccccacccacctgtactacccaaaccccccttttttttttacttatgttgcttttaagtcgattcaacacgcaccaaatgttgtaggaccagactttcaacagcacaagtactccacacaagaaattaagtggcttacctttacaatcagctcttccctcaaattgtaggacaagatacaggactatcattaatacgacccttggctttgtcatgaactgactgttgtatgacctgttttttcttcttttctgtgaaatttaatcaatcattaattaaccatctaccaggctttcaaatcatatcgcgaatgcgtaatggatacatgggttggatctgtacacctacattttacatctgctacctcaagtgtttttttgtttgcaactcattttatatatgctacctcaagtgttattttttttgtctgcaacttatgtaacgattgagtccttttaaggctcatatcaaaattatttagtgggccaaggactaagatatggtcaaagatggtccttcgcacacagcattgctttcagcctttgcttcagctgtaatccaacgtcctcttagcttaatctacagatttatgttctttctctgaagcaattatgtttaccatgttgcacctgaatacctaacaaattagagatggaaaagtttaacatttggagctactttgtttgagttcgtaaataaacctatggctcattgagagtggcattaatcgtacattctctgcaaactagtcttagtgtttttttttcagattctaaagattttaaacttcagtttctacaagattacttcattctaggatcaaatcttttaattaatcttgtaacatttctgacaactctgccaaccctgacttggaacttttgcttgtgtgcaggcagagttgctgcgcgctcttggtggtgtgaaagcttcagcatgcctcttaggtgttcctcttggtcacaactcatcgttcttacagggacctgcatttgctcctccccggataagggaagccatttggtgtggaagtaccaactctagcacagaagaaggtacagttaacgtgttcaaactatatagtagcatatcttgtatacaataagcatttattgaaatatgccttgccttcttgttgttcaggcaaagaactcaatgatcctcgagtgctaacagatgttggtgatgtccccatacaagagattcgtgactgtggtgttgaagatgacagattgatgaatgttgtaagcgagtctgtcaaaacagtgatggaggaagtgagcacattatcccaccatgcttgtttcaaaaacttgtttgtcgatcatctcagctatttccttgacagtagttagcataattttttgaagtttatttaaggatctggtgaagtctgacatacatcttaattaattttaggacaaatatttgcttggacaaaacttaaagctattgaagcagagtaatttattaactatgccatacttttatgtaggatcctcttcggccattggtcctgggaggcgatcactcaatatcttatccagttgttagggctgtgtctgaaaagcttggtggacctgttgacattcttcaccttgacgcacatccagatatctacgatgcttttgaaggaaacatctattcgcatgcttcttcatttgcaagaataatggaaggaggttatgctaggaggcttctacaggtacttttatacagcttttcgttgttttttgagggaatcaccaggagggttggtatcccacttgtatatctttgagttctgcattccagaactatcatagtactactgaatggatgtttatctaaacaaagggactactattgaatgaacgaacgaatgaatgaagtatctcttttatttttaagcccaaatttaaggagaaggaaaatacaaacacaatattgaaatattgggttataatcttctctataactagcgcagctgtcattgctctgaaaatatggtttcacctttaatcctgatggttttcaggttggaatcagatcaattaccaaagaagggcgtgagcaggggaagagatttggtgtggaacagtatgagatgcgcactttttcaaaagatagggagaagcttgaaagtctggtaattttactaaaaataaccacgtcaatgtctttgcaatcacctgggtaattttaatatgatgattggggacatatagtattgatgtgtgttatgattctttgtagtgtgataattgcaaatttgcacttggccattcatttaaacatactaatgtatctatttggcccaaaggagttttagggtccttttgggctctgttactgcctccacagcttttggtctctcttcaagttgcaactctgatacctctaccataatgttagataaactatcatgggattaagtttaatgctgtaatctattcgtagatgctctgtttggacagccttgtctacaacaggttggcaaccaaggccatgggtgtctagtttgaactttcaatgctttggcgatgttaacctaggaaactttggtagcttggaccaagatttgccattaacttggtttgtcaccaaaatttggcaaggggccgttcgcattggctccctaatctgtttttataaccaaacttcatcagtcgatgggctttgtagtgtgccttgtggaaatagctattcataaaattgcttaaaaaataaagtggcagagtgacagttaccttgtcaaaaccatcaagatctgttggaaagtcaccctgttacctgtcattgttgtatttaaccagctgaaaaaggaaggttcacaagtggaacttaggattaagccaatgttttatttattttccaaagtaaaattttgatgccatccaatctatgtatatgtgtttcccagttgggatccatagcatggatatccttttatccaaatgtctaacttattctttttatttattggcagaaacttggggaaggtgtgaagggagtgtacatctcagttgacgtggactgcctcgatcccgctttcgcgccaggtgtctctcacattgagccaggaggcctctccttccgcgacgtgctcaacatcctccataacctgcaaggagatgttgtcgccggagatgtggtggagttcaacccgcagcgtgacacggtggacgggatgacggctatggttgcagccaagctggtccgggagctcacagccaagatctccaagtgagcatccattcagattcagggcatatcatatcaccaaccaaccccttgagtctgaagcagcaaagaggatgattcccagactcctttagctgttagtctaggttcctatgtagtagacatcagctatgccagattttgtatgtgaatatactcattaggttgcaataatgtttgcctccattttgcacttgtgatgttatggttatccctcatcatcgtgtgctagaagaatgcatatgaaccgtttttgtcgtgctttcaggcaacatgctgacgacaaaaatgcatggccaataagagtaataaattattggcattttaaagacagaaaaaaagaatgatagtactatactactattatatagaaagtactttgccaaaaaaaagagtgatattttacgaggttcaagtggagtggtgtggtggaggtggagctggtggcaagtctgtgtcaaccatggcatcgccctccggcgccggcaagccaccggccgtcctcctcctccggccggtggaccagcccttcgccgtcgcgctgcgcgagcgctaccgcgtgctcgacctcctctcctccggccagcctctcccggccttcctcgccgccgccgccgccgcgcctgacccgccgcgcgccgccgtcgtcatggggggcggctcaatccgcgccgacgcggcgctcttcgacgccgtgccttccctgcgctgcgtcgtcagcacggcggccggcgtcgaccacatcgacctcgccgagtgcgcgcgccgcggcgtcgtcgtggccaactccgggacggtgtactccggcgacgtggccgaccacgccgtgggcatggtgatcgacgtgatgaggcgcgtgtcggcggcggagaggtacgtccggcgagggctctggccggtgcagggggactatcctctcggctccaaggtcagcaccaccttcctttttttcttttcttttcttcaactaatcaccaacactaactgcagtctaattgagtttatgcatttttattttttattatatgtacgtataatctctccgatttccattattttgtgatgcattttatttgcataactaagaaagcaattgaaaaaaggagtgaaaatagaaccagctcttgtttacgttatcccagcacagggcagagaagcagcatcagcagaagttataatttcacataactacagttttagcacgaaatttctcacaaaactatataattggaatggaatgt

SEQ ID NO: 802 - DNA, 2897 bp, Oryza sativa
atcggatgtttagacactaatttaaagtattaaatatagactaattacacagatagaggctaatttatgagataaatctattaatcctaattaatctataattaacacatatttaatttaatatttattttagcactgcattgtcaaataagttagttagacatggttaacttattatacatattagctcaagtagtataagctaataaataataagttagctataccattaaatttgctcttaaagataatcaggcaggctgacaaaccggccaatgtcacctgccacgtgccgctcagattcatttcgactctgaaaagtttttcttttggcagtaaaaccgataatactcttttctttttaactctgaaaatgttcaggatctactgaaaagaaggcatgtacggagcacatacatacgtacgtggagtggagaagtacgtcagagaaaacagggtgcgggaaactcttttaaatacttgggtgaacgtacatccgtttcttgcatgtcatttaaatagttatgaaaaattttaaaaaaaattgacatgataggttaatatataatatatcacttcacaaatatgtaagttcaaattcgacttctaaaaattataacaaaaataacaagacttctaaaaattataacaaaaataacaaatttgactgtgaatatacgtatactagttagagtttgatttgttatttttgttacaacttgtagaagtcgaatttgaacttgcatgtttgtgaagagatatattacatattaacctatcttgtgaatttttttagaattttttcataattatttaggtgacatgtaagaaacgggtgaacgtccacccgagagattagattagaatccatcctcaacagggggcagatcgagcacagtgccaccgaccactccagcatatgcaaccactcgtggttttcacctcaaaaccatggtcgtctcctctccttggtgcgtgcgtgctcccccaccttgctgccttcgcatcatccgatgatcgcattctctcgcctataaatccagaccccctcctcttcaatctcatctcatctcatctcgctcagcactactgatccaaccagtaggcgattctctccacctcccagctacttcacttcaggactagtttcttctcagctccatcgatcttgctcgacaatgtcgacgacggtgacccgtgctcacctggagcagaggctcgccctcgccaagcgctgctcccggggtacgtacgcacgcacactaaaccaccatgtttaatctcgctttgtcttgcattccatggcgctaataactgaatatatacaaactgatgtatgcttcgtcgatctgcagaggcgaaccttgcaggggttaaggcggctgctgtcgcgaccatcgcctctgccgttccaaccgtgagtgtgctcagatgctactagcttcttctaattcctccttgtgttgattcttcagcagagagtaggtgtactaacttattagctgcatatgtgtgttgtttcatcgatcagctggcgagcgtgaggatgctgccatgggcgaaggccaacatcaacccgacggggcaggcgctgatcatctgcacggcggccgggatggcatacttcgtcgccgccgacaagaagatcctctcgctggccaggaggcactccttcgagaacgcacctgaacacctcaagaacacctccttccagggcaccggccgccctcaccctgccttcttcaggccatgatcagcaagctagtgctgcttgcaatctgctgcagaaagtagctagtgttgtgtacttggatgtaatatactgtatgctccagcttgtattaataaacaatcttaatttgatgaactcaagaatggatgcggtggttcatgtgcactgtagtacatgtttcttgttccttgaactcgaacgaatttgaactgcctatacattttgtaaacgtcccctagaacactcgtatataagacgtctaaaagtaaaaagaactctcatttgtatctgcacaagaaagcgaaatggaagctccagatcttcagagaaaatgtcacacgagtatctagactgaagaaagacaaatccactgatctgaatctcctttcagatatctgcacttgagagtaaattagctagcacattcgagcaagttacagacaattctcacccacctggagtagctagcagcagtagcattcagtcccaaaacgtacagaaagctatcagatgaagatgacgacgcttggtcgatcgaagcagaaaaacaaccgattaatatcagctgcggatcagaaaatcgaattgcggcgcacgacggcgccatactgcaatcatgcgacgtcggccccatcaggcaacgcaaaagagcgaacagctttttcttatcctgctttaattttgtgtgctatagaaaacgacagagatgcagagagagcccacacagatggagatcatctgcagacatggtaagaaatggacaggaaggggtgctgctggtgggtgccgatggcgacgcccacaaaacaggagcggccatcgatgacgttcagccgaccggcggcctacggtttttcagaccggccggcgatcgatcttgctctttcagaaaatgcagaggccaaatctcatgttcgttgtttagtgactccagaattacagtaatttttttctgatcaagcagatttagtgctagtatcaattttccgtcagttttgaagtctacagtgactaactgtaattttcactagtagagctacatataggctatattcggatgtctttgttggaaattaatcctttgtgcgcatgtaaaacagaacaattcattagcacataattaattaattattagtttttttaagaaaatgaattaaaataaaac

SEQ ID NO: 803 - DNA, 16315 bp, Oryza sativa
gttaaacttgtggatcgataagatgatgatgatgagaaaaggtgaaaaacaactgggtttcgccgcctaattgagcgcgcggctttggctccccgcgcccgctcgcctcatcggcatcgccgcatcgccggctgtgcctcgctgtcgccgtggcccccgccagccgctccccgtttccgcacgtcgctctcggctcgctgcagctgagctaaaagattctgctttagctgcgtcggattacgggctttgcggtttgcgatcaacaccctctgaagatgtaaattatcgcgcattttgcccatagttttttttcctcttgtgagggttgatggaagattgtgagcttttgaagtctacattgtgtaatcttcatataactgtcatgcagttctttgtaactttggatgacagtatagaaatatggttcaataattatgtgctttttatcttgtgttgatgttcattcctttgtgtttgctttaattatgggagtgttttttaagtttactttgagatacactcgcttcaagtaatttgatgtaataattggctgtaactcgctaggtaaaggccgggatgattttatattccataattagaaaaaaaaacttttttcaccacctgcagactgcagttacatttcctaccaaaatgcatgccatttgataaaattcttagttataataaatttaggacggaggagtataatttatagcatactgtagaaattttttcaaattatgatatgtccctggaagtatttgctgtaaaacattggagtcccccctcccggccatgttgctttagaaaaaaaaacattgatgccacctacaaggctacaacaagaatcaacgaagaatcagagggagaaaaaaaaagaagtccaagaaaataccacacgaaaatctacgggaagatagggggtggtagcggctattgcgggtcccacacaaaataaccctataaaaatgagggcgcgtgctgctctgtagaacttcagagcagagagagaagaagcgatacacactacactaccacgaggtggagaggcgaagaagccgagcgatcggagaggggagaaagcggccggcgagccgcagttcgccggcgatctccatccatccgaggtgaagaggaaacgacagttcaaatcttccacagaatcgtgaggtataggaatctcagctttgtttgtttttacggcgtgatctgcttctactacgtgtgttcgtctccttttctgttcctcttttcccggtagatttctcggtttatccgaggagttgttggtcacttttagttatccgtaatacggagtagtacttatcttggttttatctaagatgggtagaactagacaattctgaactttctgcaagctaatgtgcagttctatattttaaaaaaaattctaatatttttttataatttaattaactacctttgttattatctctaacgttttctgttgcatttgcaaattttgtgtgcagatttaaaatagcagttctactctactagtagcggaggcattcgttcccgcgcgggcaatgtcggcggcgcagggccttgcgctgaagctgcgcgccgcgccggcggcgggtggcgtccgcggggagaagcggcgccgcgcggcatcggcgaccgcggcggcggcggcgcggcctcgccacggcgccatgtcgctggagggcgggttcctcggcggcgcgctccccgccgaggaccgggtggcgccgcgggcatcggcgtcgcgccaggcagaggcgggggctggggcgggggcggcgcgtcctcctcccaggtcgatgtcgaagatccccgagagcagcattgggctgtacgacccctccatggagcgcgactcctgcggcgtcggcttcatcgccgagctctccggcgagtacagccgcaaaacggtgaggtttccgcggctaagcacggcgctggagttgattgttcccgtgcaaacaatcgaaacccccaacgcggcgtgaatttctgatattctgaaattgttctcggttttgcaggtcgacgacgccatagagatgctcgatagaatggctcaccgtggcgcctgcggctgcgagaagaacaccggagatggcgcaggcatcctcgtcgctctgccgcacaacttcttcagagaggcaaacctacttgaagttttaagccgagaaatatgggaattttctaccgctgggggaatcatttttttttctgcctgtttttgtttttttgtgttctgacaggtcacgaaggacgcaggttttgagcttccgccgcctggtgagtacgccgtcgggatgtttttcatgcccacagatgacaaacgccgtgaaaagagcaagcttttgtttcgtgaggttggtgaccaagcagaacactagaacagttcagttcaatcctattgtaactgatatcatgataccattctcaatttcgtgttgtatctttggatttgtttgggttcatgcagaaagcagagttgctggggcataccgtcctcggctggcgccgggttcccacagacaactcgggcttgggtcaatcagcggtagatacagaaccagtgattgagcaagtgtttgtcaccaaaagtgcaagttcaaaggctgattttgagcggcaggttatttgatgagccagcacatttgaactttatggatttcatccgtagctgttaatttttccttgacttgttcttttgttgactgcaactccagatgtacgtcctacggaggttctcagttatgtccatacgagaagttctaggcgtcaagaatggcggaacaaaagatttctacatgtgctctctatcttcaaggttctgtgttaccatcccattaaagaatgtggtttaagtttccaaccttgggtaatttgaagcgctagccactaaggatttcagttatctgtattaagcaacagtaagctgtgatatggaataaaaaaaaacatgtttcagaaatgcttcattttgataacaaggaatagaagaaaacttttggatgtttttttttcctttgtgatttgatctcatctgaagtgaagtttgatttggtcacatgtgcatgcattccattttctgccaagtaattatttcctgaaattcggttttttacaggaccattgtttataagggtcagcttaagccaagccaactcaaggggtacttctttgcagacttaggcgatgaaagcttcacaagttacatggcactggtaagtgaataaccatttcaatattgtctgaacaacaaaatccatgatcatagtcagaagataggattactagcagcaagatttttgtgaggatatataatgcttctaagcaggcatcaaatatcctcttttcttttattaatattaatatgctatttccctcctgtttcgtgatgcctttggctgaagctgtagaaactgaaactgtgtcagctgatgcccaacaaaaaagacacttcagaatccttgtgtagttctgctattaggtactgctttttcagaatgtgtatcctaattaggtggtttgaacaaactttatttggcttgaggtagcttaggttctgaaactgttttacatggatgatagcatatggagcaggattcaaggatagatagtactggcctactgggtattcatatgaaaccatattgcatatcatttatatgtagttgtgcaaaagatgaacaaggtatagtttaaaagttatgcatgcaaacagatccactcaagattttccacgaacaccttccctagttgggatcgagcgcaaccaatgcgtgttttggggcataatggcgagatcaatacccttagagggaacaagaactggtaatttcactaaacacatctctcatcattttcttgtgagcaagaatcttcacatgcctatggaccatggagcttatatttatatgcttacttgcacttttgtcctatttccatgtttggtaggatgaaggcacgtgagggtctcttgaagtgcgagggactaggtctaacaagggatgaaatgttgaaacttctgccgatagtggatgctacatcttcggattcaggttccattcctttatcataatttacacatgataaaaataaaagcagtagtttgctgctagctctgtctctgaaacaatgtgtgtgtgtgtgtgtatgtatacatatatatattgggaatacgtgagacgcacatttttgtattaagagaaataaatgtgtatatttgggattccatatcccttttcacctgtcaaatggaagtatggccatctttgcaaagttatttattgaattatcttgtgaattcaggtgcaatcgacaatgttcttgagcttctcatacaatctggaagaagtgcgccagaggctgtcatgatgatgatccctgaggcgtggcaaaacgatgttaacatggaccctgagagaaaagctttgtatgagttcttttcagcacttatggagccttgggatggaccagctctaatctcatgtaacaagataaaactaaactctcttcttaatattgatgcatgcattatgatagataagtatcaattctgacctggtcttcacgcacagttactgatggccgctaccttggtgcaacccttgatcgtaatggtttgaggccaggccggttttatgtgacctacagtggccgtgtaattatggctagtgaagttggtgtggtcgatgttcctcctcaagatgtttcaagaaagggtaggctaaaccctggaatgatgcttttagttgattttgagaaccattgtgttgtgaatgatgatgaattgaagaaagagtactccaaagttcgtccatatggagagtggctgaaaagacaaaggatacaactcacagatatcatagaatctgtaaatgaagcagagagaattgcaccgagcatttcgggtgcacttccagtaagttaattatcttgctaacttttggagtgtcctgttggttagtaatttaccatgtaatggtgaggtattttatggatttttcacactttgctgcagattacaaaggagaacaaagcagatatgggtatctgcggaattctgactccgctgaaggcttttgggtaagcaacagcccaatcttagtatgtttcttctcatcctccttgttgaaaaattacctatttggttggattcaggtatacaagagaagcccttgaaatgctgatgctaccgatggccaaagatggacaagaagctcttggatcaatgggaaatgatactcctctagctgtgatgtcaaacagagagaagctgacttttgaatacttcaagcagatgtttgcacaagttacaaacccaccgattgacccgatccgggagaaaattgtcacatctatggagtgcatgattggtcctgaaggtgacttgtctgaaacaacagagcggcagtgccatcgcctcacgcttaagagtcctttactgaatacaaatgaaatggaggctattaaaaagatgaactaccggggttggcgcagcaaggtgcttgacataacttatcctaaaaagaatggcaggatgggcttaaaacagactttagataaaatttgtgctcaagcacgtgaagctattcatgagggctacactattctagttctctctgatagaggtcagtaagattcagttacaccagactcactaagcatgaattttatgatccatgaatttatcatcatctagatatagattcatgagcaatagtgttagtatgaaatcaatattctccccaaaatctttacttttgagctgaattcaatattgtgttattgtggtatgaaagatatcaagatttttttctatacagatcatgaataagtatattttcgtaacaacatgttaacagtcaacatcttagtttcatcttaggttaggtcgtacttagtttttcttgctcctcttggatcatgtgtcaacatagctcagcttttcttcttttttttttttttgcatccaagctcagctttcccaagcttgtcaccatgatatgtgctctgcatttcaatgtttaattctcaaaattaacttgatccgtcatctgtagcatttggattaaaacatttgctttaactagaagtttccatacaggtttttcttcagagcgtgtagctgtcagttccctattggcagttggagctgtccatcagcaccttgtctcacatcttgagaggacacgcataggattgttagttgaatctgctgaacctcgcgaagtgcaccatttttccacccttattggatttggtgctgatgctatatgcccttatttagctatagaagcaatatggcggttgcaaattgatgggaggattcctcctaatgatgggaaaccttatacacaagaacaacttatcgagaaatatttttatgcttcaaactatggaatgatgaaagttcttgcgaagatgggaatatccactctggcatcttacaaaggtgctcagatttttgaggcccttggtcttgcttcggaagtggtcagcaagtgttttgaaggtactcctagtagagttgaaggtgcaacctttgaaatgcttgcacaagatgctcttcgtctccatgagattgcattcccatcaagaactttacctcctggaagtgcagatgcaaatgctcttcccaaccctggggattaccattggaggaaaaatggagaagtacaccttaatgatcctttttccattgcaaaattacaagaagcagcacggattaacagcagggaagcatacaaagaatattctaggcgcatttacgagctgaataaggcatgtactctgcgtggcatgctgaaatttagagaaattccaaaccaaatttccttggacgaggtagaacctgcaaaggagatagtgaagcggttctgtactggagcaatgagttatggatccatttccttggaagctcatacttccctggctgaggctatgaacacccttggaggaaaatctaacacaggtatctcgcatcatatacggacctgaacttttgctgagtcagttactttaaatgtcatgtgtgctttgtgttgcatgtttgcttgatatagttctaagcttcttgatttcccatgataacttgcaaaaactttgagctaaaaagtaacatctaaaaactagttggctcttttagatccttttaacattgttattcccaaatcacttgaattatgcttaaagttcttaattatatgtgcctggaacgtgaaggttatataactattaagaatgggagcaaaggccagttaacaactcaaacactgaccttcttccgtggcacaggttaagctttatagtagccaaattacccttgatattggaaatagaagtataatatccccccattagttgccagaccaatttttgacggtgtcgattgaactgcgtatcattacatagtgggagggtaaccacataagcgtagagttgtaacaccatatgacccaaaattcgcccaatggctgggcctccatttggtggtgggggatgggccactcttgcatagcaccttacttgggctttcatccttgctttcccagaaaggttaacaagatcaggaaatgttatattttgggccaacagggcttatacgctactatagctaaaggtaaacaggcaattggtttttttacctttccagtcgaaccatttgctttgggtagatggtgttgtgagaactttgttcctttcaatcttaatacaaatgatgcacaaagcttatgcgcattccctaagaaaaacgtaagtgaataaatcaggggatcctttgacaggcgtataaggctttcttttttgttaattgatagtaggcatatatcacttggattcaatccagtagcttagatcatagtctttgtttgttctccgatttcagggctagtcgcaatttgatatgaacctttattttaaattccttctgaactattttcatatgctacacagaaacaaatgggaagatgcctgttgtttgcttatttgagcacagcagctaggctgatgcaagttatttatcaacttttgttcattcttctctaatattgcacttcctatctgcagagcatcttatgtaaacctttttatgacttatttgtgcacagctatttatttagaatatcaacttactactgtagtgaatttgctaactgactccattttatatgttaattgggacatctaaaaaggtgagggaggggaacaaccttgccgtatggtgcctcttcctgatggatcaaagaatccaagaataagtgcaatcaagcaagttgccagcggaagatttggagtttccatctattatttgactaatgcagttgaggtgcagataaaaatggctcaggtatttgaccagattggttttttgtaaaactaaacgagttacttcctgcaatatgtccatgaccactggtctggctatttcatcaggcagtagaaatttatgtcttgttcctctaactgtatagggtgctaaacctggtgaaggtggtgagctaccaggccacaaggtcattggtgatattgcagtcactagaaattctacagctggtgtagggctcattagcccacctcctcaccacgatatatattctattgaggatctcgcacaacttatccatgaccttaaggtatagtctcatttgtaaaaagtctcatgatggtggcttataactatttagtgcaagactccagtttgccacttacacatttacttccttattaattggcatttttttgttgtaatgtttcatattagagaacctttttaattgaaatcatgcatgttgcactttacagttttgcttgcttatgctatatcgcttctttctactgtagaatgcaaacccaggtgccagaatcagcgtcaaactagtctctgaagctggtgtaggaattgtcgctagtggtgtggtgaaaggacatgcagaccatgttctgatctctggacatgatggaggcactggagcctccagatggacagggattaaaaatgctggacttccttgggagcttggattagctgaaacacaccagactcttgtggccaatggtctccgtggccgagctgttcttcagacagatggacagatgaaaactggtagagatgttgctgttgcttgtttacttggagcagaagaatttggattcagcacagcgccattaatcacacttggctgcattatgatgaggaagtgccataccaacacttgccctgctggtattgctacacaagatccagtgctccgcgcaaagtttgctgggaagccagaacatgtcataaactacttcttcatgcttgctgaagaggtacgagaaatcatggcacagcttggcttccgcactgttaatgaaatggttgggcgatcggacatgcttgagatcgatcccaaagtactggagggcaacgagaaacttgaaaacattgatctctcacggctgctgaaaccagctgctgaaattagccctggggctgttcaatattgtgttgagaagcaagatcatggcctcgacatggcattagataacaaactcatagcctcctcaacagctgcccttcgaaaaggtgttcgtgttttcattgagacaccagtacggaacattaaccgagctgttggtactatgctcagccatgaagtcacaaaacggtatcacattcatggattgccatcagataccatccatattaagctgaatggaagtgctggccaaagttttggtgcttttctctgtcctgggatcactcttgagcttgagggagacagcaacgattatgttggtaagggactatctggtggaaagattgttgtgtatccaccaagaaatagtcgatttaatccacaagacaatattgtgattggtaatgtggctttatatggtgctacaaagggagaggcatatttcaatggtatggcggcagaaaggttttgtgtccgcaattcaggagctcaagcagtagttgaagggattggcgatcatggatgtgagtacatgacaggaggtacagctgttattcttggaaaaactggtaggaactttgcagctggcatgagtggaggtattgcttatgtttatgatgtggatgggaagttcagtagccgttgcaactatgagctagttgacttgtatgctgtagttgaagaggatgacatcacaacattgagaatgatgatacaacagcacagacttcatacacaaagtgatttggccagagatatactcttgaattttgatactctcctcccaaaatttataaaagtatatccaagggattacaagcgggttttggataaactaaaagaagagaaggctgctaaagaagcagagcaaaaggcaagagaagtggtggataagaagccagttgaagtaattcaagctccaaatggcatttcagtaaagacagaggtaaataaggtttaagcaggattatttctcattctctatatcggtgatatttaacttgactgttggaaatttatgatgtccttcttaaaatagttattattgtaattctgtaagctaagctttctagtctgacttaaagtctttgatatgcagaaagtaatgaacgaagagccatcaagccgaccatcacgagtttcaaatgctgtaaagtaccgaggtttcataaaatatgagcgagagggtacttcttacagagatccaaatgagcgtgtaaaagattggaatgaagttgcaattgaattggttcctgggccactgctaaagacgcaatctgctcggtgcatggattgtggcactcctttctgtcatcaggtgatactcagtttttttcccttttgtattaagcagttttttttcataaaatacaatgatgcttttcagtacagtagttttatatgaatgtcacccggcaaaaaagttttatatgaatgtccttgatgctcttgatttcttgtccatatatattagtgcatatagtcgtgcattcgcacgaatttaaccatcctctatactgaatatctttacatattatttgtagtaacaaaatatacttccctttttaatagatgacactgttaacttttaacataatatttaatcattcatcttattaaaaaatattatgtaaatgttaatttttttggtctgacttgttttatcattactgcgttatgatattttggtaagttggcaatggtagggtatgcttagttagttaccctataaaatttggtatttttttctattttatttaatttttaggtaaactaaattcataatattttactttactttagaaagtgtgttcgttgaaaaaaaaactgagatggttaatttgtgtgctaaacaaaaccgacaatcgagtgtactttatgcaatgtttaaaaaagtgtgtaaagaatataatctatctattatattattaaaggaatagaaaaagaagcctccacgttcgctctcatggcctagaaattctcacattaatcggagaaaaagaaaagacagagtccatatagaaatacaatttagaaatagctgaaatttggaattaaaaaataaggaatattagaagaggagactagagtccatatagaaatacaatttagaaatagttgaaattcggaattaaaaaataaggaatattagaagaggagactagagtccatatagaaatacaattaggaaataactgaaattcggaattaaaaagaaggaatattcgaagtagagtatagagtccatatagaaatacaattaggaaataactcaaattcggaattaaaaaataaggaatattagaaaaggagactagagtccatatagaaatataatttaaaattagttgaaattcggaattaaaaaataaggaatattagaagaggagactagagtccatatagaaatacaattaggaaataactgatattcggaattaaaaataaggaatattagaagtagagtatagagtccatatagaaatacaattagaaaataatagaaaatcggaattaaaaataatgaatattagaagtagagtatatagtccatatagaaatacaattaagaaaaaaaataaattcggaattaaaaaataaggaatattagaagtagagtatagagtccatataggaatttaaaactaactaaaattcagaataaacataataaaattaaaagtagagtttagagtctgtataaaaatacaatttacaaataactaaaattcgagattaagaaaaacatggaaagaagagtttaaagtcaatataggaatacaatttagaagtaactgaaattcgaaattaaaaattaaagaatattgaaagataagtttagagtccacatagaaatacaattagaaataataaaaattcagaaataaaaataaataatattggaagaagagcctagagtctatatagaaatacaatttacagaaaatttggaattaaaaaaatatattaaaagatgagtctagagtccatataggaatatatatattttacaaataactaaaatttgatattaaaaataattaataactaacacgtatataaaatacaatatgaatattacacattagtagtttcgtaaagttattgcaaaatctaaaattatgttgtcattttaatatatttggataatatattgagaaaacatatatgctattatatgagagaaaatataatgatgctagccgcgcaatctgcgcgggacaccatgctagtttcaatagtaaaactcaaaactttcaaggttcttcacgtatacgaggttttaattgtacacaaggtataaaaataatttaccaatattcaaaactcaaaacctccaaaattatacgcctaagaaaaaaatattttttaggcttaaaaataaaaaggtgccatggttgtgacatattggcaggttcagaggtggacttggaatatctagtaacttccttgccactcttccatcggacagctgagatttattcttcagtttttgtccttttatcgattctatggccattatttactacatgatgtggctttttctctttgcatcatcagattgtcttttcacttgttaagatttgtgaaattttcttggtatggttcctgtatttttcttatatcaaacttttgcaggagggttctggtgctggttgtcctcttggaaataagattcctgaattcaatgaattggttcatcagaatagatggcatgaagccttggatcggctacttgagacaaacaatttccctgagtttactggacgagtttgtcctgctccttgtgagggttcgtgcgtacttggcattatagacaatccagtatccataaaaagcatagagtgcgccatcatagacaaaggatttgaagagggatggatggtaccacggcctccacttcggagaacagggtgtgtgttcggcacaactttgtacttgctttcttatatgagttgaagcatgtaacaatagctgcacctaaagctacttcatttttttgcagaaagagagttgctattgttggcagtggcccagctggtctagctgctgcagaccaactgaacaaaatgggccatttcgtgactgtctttgaacgtgctgaccgtattggaggactgatgatgtatggggttccaaatatgaaggctgacaaagagggcattgttcagcgacgtgtcgagttgatggctaaggagggggttcaattcattgtgaatgcccatgttggaagtgaccctttatactccgttgaaaagctccgctctgagaatgatgccattattttggcctgtggagctacaaagccaaagtgagttaatacaaaaacgaaaaaaagaagagtttgtaactctagtttacatctttcttggcaccagtttttaaagtctaagcaacacagtctatatcattcatgcctttgaaacttggctaatgtttagagcattatccttgagcagagatctccctattcctggacgggagttggcaggcatccatttcgctatggaatttcttcatgccaataccaaaagtttacttgacagcaacttggaggatggtaactacatatcagcccaagggagaaaggtggttgtcattggtggtggagacacaggcacagattgcattgggacatccattaggcatggttgcaccaaccttgtaaatcttgaacttttgccagagccaccaagaaagagggcacctgacaacccctggccccaggttagttccctcatcatataaaacaacagcatctttatattctttttttagtgaaaatctttgtatgtttagaatgtaagcattgcgccactacggttgcctgaaattccactaacattactctgttgtgtttctactattgccttcagtggcccaggatcttccgtgttgattatgggcaccaggaagcaactagcaagtttggaaaagatccaagaagttacaaagtcctgacgaagcgatttatcggagatgagaatggaaatgtgaaggcccttgaggtaatacgtgttgaatggggaaaggtgaacggaaggttccaattcaaggaagttgaaggatcagaagaaattattgaggccgatcttgtcctcttagctatgggattcctgggtcccgaagcggttagttttcctccctttctcttatgagttatgacaagaatagcattacacaattgtgcacatagctatctgtttagagaccaaccaacacatagtgcctaactgcatatccttctacagactgttgctaacaagctgggtctagaacaagacatgaggtcaaacttcaaagctcaatttggaaactttgcgaccaatgtggaaggtgtatttgctgctggagactgcagacgtgggcaatcactggttgtttgggccatcacagaggggcgccaagctgcagcagccgtagacaattacctgtcgaaggatgatgaaggtgaaaccaatggcacagaggacattgctgtctcaagtgaaggtctggtccaacccgtagttgcataggccgagagaacatttctgcaattttgatacagcattgatgatgcgaagatagtagggccatgcattttttagctataaaaaggtaaaataaagggcctgtaaataatttacaagaaaagggggcccttttgtttatataagtatgataaaagggaaattttgcggacgcgtatattttttccctgtttcttcttgtgaagagatgcaaatcctgtgattataagagcaatgtctggtttttgttaaataaatgtgaggggattctgttaaaaacatctatttattatgtgtaagtacataatggatcttcgtgtttctcttccatccatgaacctaccacaatgctgctgcatgaattgtaaatgtttttaaagtttttgaagtgttgtcattgagtagttcaagaatcgatctgcagccataattaatcagttaaactttttttcttaaacaaaagcagaagctctgtttcatttcattgattcgcttcctttattgaaaagaaactcaatcctcgtgtgacatgtttggttgttattaactgttttataattggagcgaagtcacgcattattagtctgactagaagatattactgacgacacctgaggcaaaagaaattcatatttgatatgccttgttctaaattggcaatgccgttatgaaaaaaaaaagtacagtccattagtgactgcgtgcatgacgaccaataattattctggattgagcaacgaaacacaaaagaatatatagaacgggtaacaagattgaccttgtaaaatggtgctgcttcaattatgagatgtatatacctgttagatgtaaacaattttattgagaatttctctgtaagaactttttttaacgaggactttttttttttgaacaaactggcaagccgccaatttcattaaatagagatggagtaaattgtacaaaacccaaaaaaaaatgaaaaaagttacaagctcagagcctttggaccgagctaaccacataatgagccagttgccaaggttcttctcacccaccaaaacacatgttttggcttcctctttaatcttggctaggaggctggttgccaggagctccttttgttggaaggtcccgcgaggccactagcaacaggagagtttaatttcaaagtaatgatatgcacttgctagtgtaatggtattgtagtaggatgtattagtttaaccatatgatccctttattttggttctcaacatgataatattttatttttaattatttgacaaaaagattcccccggttgctcagtccttttaaaaatcaaagctatactgttgcataccatatttg

SEQ ID NO: 804 - DNA, 5876 bp, Oryza sativa; identical to SEQ ID NO: 328

SEQ ID NO: 805 - DNA, 8497 bp, Oryza sativa
tgggtggttttagaaatggttttggctgacgtgacgcctacatggtggtgttgactcggtcttcgttccacgtgtcgtagacgtgtcgggcattagagtaaaaacaaaaatttgtaggaccaacatgtcattcacacgagaaaaaatagtgggacccaccgacatgtgggcccacatgtcattctcaccgacgccccatcccttcttcctcccctctctctctcctttctctctctttctctcccctttctcttcgtctgcaggcggcggcgggtgttcgagggccgtagcggcggcagccagcgggagggcgggcgctgcctagagacggagcggcgacgaggcgccctcgaggcggagctatggctcgtcgtcctcaaggcgttccgatggctcccgccgcccatgcatgtcgtgacgcctgtgccgccgtcgccgcctccggcgccggggctctgctccacgttggcgtcggcgccgccggcccatgcacgcgcacacatggtgctctgccttctctcatgtacctctccagtgtctccctgtgcctctcctcgtgctcccctctcatcagtagttggctagctgcacacgcaaaatacattcacactcatcgcctacatagctcactctcactgacatcatatcacgtcaatgcaaggtgtttgttgctatcacgacgtatcctggcggcaaggatctggacgccggcatacttgacgtcccagctgaacttggtgatggcccagcaggtgccgccaaactcgtccgcgttgtcgacgatgtagtcgaggtaggcggcggcggcggcaaaggcatcgcgacgtgcgtgggcgcggcgggagccgtcgcgacgccttgaggacgacgagccgtagctccgcctcgagggcgcctcgtcgccgctccgtctcgaggcagcgcccgccctcccgctggctgtcgccgctacggccctcaaacacccaccgccgcctgcagacgaagagaaaggggagagaaagagagagaagggagagagagagagagaggaggatgaggaagaagaagggatggggcgctggcgagctcctctctgcgggtgaacggccgacgagctcctcccccgcgcgtggacggccagcgacctccttccctgtgcgttgtcgccgccgccccgcgctctagtgattgaaggtgagaggagaggaaaagatgagagagaggggagaggggtgagaatgacacgtggggccatatgtcggtgggtcccactattttttttttgttaatgacacgttggtcctacaaatttttgattttactctaatgccacctaagcgacacgtcgacgacacgtgggacgaagaccgggtcaacaccgccacgtaggtgccacgtcaaccaaaaccacctaggatatagtttgcaccggttttggtagttagaggagtcgatatatccggttttgtggttggaggtcatgaatcgtactctggccatagttgagggagttaaagtatactttttccaggaaaaaatgaatcgagtgtgtcaaactgaactgaagacttaaaaaggttgaatggcagtttgactgctagtgcattaatcagatttaaacttacaatactacttatttttttccctctcgaggaatgtctagcagtatatttgcttgacagctcaaaaatataaaggatttgcagtaccatccaaatttaggaacaacatacatggaaaagacaaatcgcctggtgcatgaggcgcttacgtgcaggaaaaataaaaggaaactgaagctggaaaaaagagagacattataatttgccgttgctcattttctattttagtgagagttacatgcgggtgcagtggtgcgtgtgagttgtgactctccacttccgtgtaatcgggaaaagaagtaaaaaagaaaagaaaaggggagtcggagagagcaccggtagcattattccaagcaggtggacccgcgtgtcatccccactctacaaagcgcaaaatcatcaagggccttcgcctcggcgtggaggagagtgaggacggcccacgcggagcagcagagagtggcgggctcagtgtcgggctcgccggagtccggccaatccggccggttcatgcttcattctctcggtgcgtgatttctccgattttcgtctccatctagtacctgaagcgaggcaaatttaattgcccccttttcggtgcaaactatctcgtcagattagtcgcatgcatgttccttcgttgaattttgcaaagttagttgtagagagaagttcttgggagggtggatgctacggtctcatcttctctcttttcccccaacaagcgagctagcgaaggggaaaatggggggagcagaagaatatccatgttaggttcgcgtgcttgcctctcggctgagctctagctgttacggcgttcgtcaggatggctaatccgtctcgccaattagaagatggataggtcgtagcgttagatggattacttgatggttgatgcgctgcccatttattgttcgtagcaggttctgtcttctcagtccgtgtgagtgtttcatcatattggctaccaagatgatcactcttcgtttatcaagagagtagggtgagatctcaatccgttgcaactgatgagtacttccttcgtctcagaatgtaagtatttttgagttagacacagatattaaaaaagtaggtagagatgattggaggagagttgtgattgatggggaagagaaagtaggtgaaaaaaatggttgtgattggttaagaggagagagtaggtgaataaatagcttcattttgggacaagttactgtactaaaaatagatacattttgagacggagatagtagtatacttcacttactaccgagtacggctttagttttgctacctccgtcctaaaatatagtaacctaggatcggatgtagcatgttactactaatctagataggcagcatgtctaaattaatagtaatatgatgtgactcgtttagtacaatattgatatattttaggatggaagaaatatataaatactgtttttttattcgaagtagttggcccatcatttctgaaatagatgattgatgccatgacgccgcttgctttctagaactactagtaattttaggtgagagctagtactgatgcgtcagtctaagataatggacaaaaaagggctacaggctactattgattatcacattaaaactctgtacgacagatttttctgattaaatgatagccatatgcccaacgtgctgcttgtctaaactgaaacctgacatcactcacagtatgcccagttgttgggtggtctattattatttataaattataactctggcatttttttattgtagggcaatatgttttccattattttccattaaaacctctaatctgcacttccactatctgctcaaaatctcaggctactttctttcctcttcctcaggacattaacctggtttacttgtaagaaagtaaagccatggactcctcataccagcatgacaagcctctgctggatgaagagaactcctcgcaagtggtttgttctctctctctctcactctcatagcgagatttgtctgatttttttctcttaaagagaaaaaaatatttggccaaatttgaggtgccttttctgctttcatcaaatggtgtgaaaatactgctttcagctgatgttttgtttctgtttaatgctctagttctagagtgttgcgaaagtaaaaaagaaatatagagtgaagttcagtcggaaaattttctcttacttaaaattattttatatggttgcactagtatggggcatggccgactggggcatgcaatccaagataaactttcaaatgttctgtctaaatatatcatccttacaataaggacataaagtggtagcaatatattactaatgtgaccataagaatggctaggcccttgcatactaataatgtttttagttagtgatactttgcagtttttttggatgatcagttaatttgcttccaatgtatataatataattttgttcttaggataaattttcctggaaatatatagaataattccatctacattaggaaaatgcacaattctctattgaaacatctataccagtgatggatgacactggcattaaaggctatttgtgttttttacttggaaatgcagacccttgaatatacaggtgatggatctgtttgcatccgtgggcatcctgctttaaggaaacatacagggaactggaagggttcctcattagccatcggttagtgctgaaaaatgatgttgcattgtcaagcttctgcttgaagatatagtaggatatttgatgctaaatactcgaacatctgaaactgatttcatttcccagcatttatatatattacagtattattatgatttatgaatattctttcctcctgtgtttgggttctgtttaattttatactggaccttttatggttcattttttattgcagttttttcattctgctcttatctggcctttacttcaattgtaaaaaacctagtcagttatctcacaaaagttctacatgaaacaaacgtggccgctgcaagagatgttgcaacttggtcaggaacaagttatcttgcacctctggttggagccttcttagctgattcatatctggggaagtactgtacaattctgatcttctgcacgatcttcattatcgtaagtgacagtatgaactaatgcacgtttgtatatcatctaaaataacgattataatcctttttttttggaagtaaacactgtaagagatgatcccaattcctacgtccactcagtgagcaaaaatttgtatcctcagtgaacaatagtatgaaattcagatggacgaatggcagtattaaactctagtttatacagttaatcttcagatgtaagaggagtgatgcattcaacacttgacaaacttttatagacatgattgtttacattttcctttatatcatttttctagacatgaccgtttacattttcctttataccatttttctagaaatggtcgttcacatttttttcctttatccttttatttagggattgatgatgttgcttctgtcagcagcagttccattaatctctactggtcctcactcatggatcatatggacagatccagtctcttctcagaacatcatattctttgtcggtttgtacatggttgctttagggtatggtgcacagtgcccctgcatatcatcatttggtgctgatcaatttgatgacactgatgaaaatgagagaacaaaaaagagttcttttttcaattggacctatttcgtagccaatgcgggctcattgatctcggggactgttattgtgtgggtgcaagatcacaaaggttggatctggggttttaccatttctgcactatttgtgtatttaggttttggtacttttatctttggctcctctatgtatagatttcagaaacctggaggaagccctcttgcgagaatatgccaggttgttgttgctgctattcacaaacgcgataaagatttgccatgtgattcctcagttctttatgagtttctggggcagagttcagcaatcgaaggcagccgaaaattggagcatacaactggacttaagtaatacactatgttgacattacaactttgatgcctatattctatgcttttatttatgcttgcatttctgttgaactataatttatttcatttctagtaatatgattttgtaagcttgtctttaactcattctagtgtagtgcccatgcgatgcactggtttttatatactacctctattttaagtatatgatgctattgacttttggacatgatgtctgaccattcgtcttattagaaaatttagtgcaaacattcaaaaatataggtcatgcttaaactatcttcaatgataaaacaactcacaacaaaaaaaaatggtactcacatagttttttcaaataagatgaatggtcaaacattagatccaaaaattaacagcgtcgtatattacaaaacactggtagtacatgaatatcatatagcttaattttaaaatttcaaaatgatggcttgaaatataaaactaaattaaattatatcaaccagccatatacttgtgtacaatatgcaaatatttttttaaaaaaatcctacagtaacactttgaataataattttaatattttgggaaactcctctttttagggagtagagatacttaattccagtaaagcatttcattctttcactctttgaaaattcttctgtgggacacatcacacaatacaaatatggaaaaccagttaacattacaagagtttcagcacattgtttataatattctctaaagaaatgtctcttgtgatatcgcttttgaaacaaagtctcccgtaatacacttatttctgctgttcatttatacatactagaagcaaaccttcattgttcatgaacctttgtttgtcaatgcaaagtcggcaaggagctgtccattccatctcagctctatcaagttagccatctatttattttatttctctcaggttctttgatagagctgcaatggtgacaccatctgattttgaatctgatggcctactaaacacatggaagatttgcacagtcactcaagtggaggaactgaagattttgatcaggatgttccccgtttgggcaacgatgatattatttgctgcagttctggacaacatgttttcgacattcatagaacaggggatggtgatggagaaacacatcggctctttcgaaatacctgcggcgtccttccaatccattgatgtcattgctgtccttatactagttccagtctatgaaagagtccttgttccagtgttcagaaaattcactggcagagcaaatggcattactccactgcagcgaatggggatcggcctgttcttttccatgctctccatggtatcagcagcattggtggagagtaatcggttgcggattgcgcaggatgaaggtttggtgcacaggaaggtggctgttccaatgagcatcctgtggcagggaccccagtacttcctgataggcgtgggagaggtgttctcaaacattgggttaactgaatttttctaccaggaatcaccggacgccatgagaagcttatgtctcgcattctcacttgctaacgtttcggcaggaagttacctcagctcgtttatcgtttctcttgtgccagtgttcacagccagagaaggcagtcctggatggatacctgataacttgaacgaagggcatttggatcggttcttctggatgatggctggcttgtgtttcttgaatatgctggcctttgtgttctgtgccatgaggtacaaatgtaagaaggcttcctgaaccttgttaacattagcaatataatggtggtggaaaaggacaattgtgttgcaaaagcatgcacccgttttcatatataaaagtaagaaaatcttgctgcaaagcatgccccgattttcatggtgaacttttgcttgatctggctatgagtagctggcagaatatgaactgttgtctactcatagtcgtctagcttttttcttaatcaaagttttttgtttgaccaagtttataaaaaaaaatagcaacacctactaaattagtttaattaaatttaacattaaatatattttaataatatgtttgttttgtattgaaaatattactatatttttctataaatttggttaaacttaaaatattttaattaagaaaaaagtccgacgacttataatatgaaatggagtatgaaatggaggaagtagatttgaatgtgctgtttaattcactctcagcaaaatacctgaaatttgtatttgaacagttgggtgtatttggtgtatgattcattatcatctcctctatcatttgagatcattaactccttttttttttatacacaaagcgcatatcattgtattgaaattaggaaattggtttcgctcagatacaaactatgtacaaaagataagaaaaggaggtacgagaactgcgcctagcgcagtggacagggtctgaggtggtgcgccctatggcctacgctcgattccccgcgaacacactcactcctctcttagggtgtgtttgaggaggaggggattgaggagattgagaaaatacgcaaaacgaggtgaaacattagctcatgattaattaagtattaactattttaaatttaaaaaatggattaatataattttttaaagcaattttcatatagaaaatttttgcaaaaaacacaccgtttagtagtttgggaagcgtgcgcgcgaaaaacgatgtgcattctcactccctatcacccaaaacgaacgcagccttaatacatatcgatatgaaagccctttcgacatgacgatctctcgcaacacatttttgaatgactgagcacaccatccagacaggtactcccatatcacgccagagtactgccacctctgcaa

SEQ ID NO: 806 - DNA, 3958 bp, Oryza sativa
ggcggcgttatctgattggactgggtgtggtcaactaaatcccggtcaatggcaactagctcaatcggtgttagagtggtgggaggccaccgccaacttgaaggaagccccaaagaaagcacttcacacgttaacacttctggtcaactgggaaatctggaatgagagaaatcgtagaatttttcagcacaaagagttatctaccggaagtctgttggccaaaattaaaaaggaggccaaaacatggtctcgggcgggggcgaggcatcttggtagctggcttgcttcttatttttagctcagtaggaccgaaggtcctgggcctggtttttcttacttgtaaagtttactctttctctattcaatgaaattggcagcttaccgattcgttcaaaattttttttttactcacctctggctacgtctatgcatacttgcatttacagctatatctgttatttttttctgtgtgaaattgtgaagtggcaaccagctgaggaacaacagatgaacagatcgattctgcgcatgcatcaggtgggtcccatattggcgttgcatattctgatccttggaggattccatgggataaaggccactctgctccggagatgcggcgccgaggttatctccttaattaatctcacatgacttcctcttatatcatgctactagtagtactatattttcagagttcacagctgatattgtcaacgcttgctgcccccttatcgctcgtaacgtaataatcgtataatcacataattaaaaatccactcttgttaattcagcaataaacttcagagttcagagaacgtgtccaggtctgtcgatattatcaggtgagagaacggagacgatgaggccattttgcaccagcacgaatcttaaggcaaatgccataaggatggcgccaacgagagcgtgccaattcccgcgcacctgaagctctataaatagctgggcgatgcgtgatcccaactcccaagccaccagcaaagccagcaattgcatccgagctcacctagcttctctcttgcaaccagcgattcgatcgattccatctccaagaagcagcggctagcagcagctagtagttgccatggactcgtcgacggtgggcgctccggggagctcgctgcacggcgtgacggggcgcgagccggcgttcgcgttctcgacggaggtgggcggcgaggacgcggcggcggcgagcaagttcgacttgccggtggactcggagcacaaggcgaagacgatcaggttgctgtcgttcgcgaacccgcatatgaggacgttccacctatcatggatctccttcttctcctgcttcgtctccaccttcgccgccgcccctctcgtccccatcatccgcgacaacctcaacctcaccaaggccgacatcggcaacgccggcgtcgcctccgtctccggctccatcttctccaggctcgccatgggcgccatctgcgacatgctcggcccgcgctacggctgcgccttcctcatcatgctcgccgcgcccaccgtcttctgcatgtcgctcatcgactccgccgcggggtacatcgccgtgcgcttcctcatcggcttctccctcgccaccttcgtgtcatgccagtactggatgagcaccatgttcaacagcaagatcatcggcctcgtcaacggcctcgccgccgggtggggaaacatgggcggcggcgcgacgcagctcatcatgccgctcgtctacgacgtgatccgcaagtgcggcgcgacgccgttcacggcgtggaggctggcctacttcgtgccggggacgctgcacgtggtgatgggcgtgctggtgctgacgctggggcaggacctccccgacggcaacctgcgcagcctgcagaagaagggtgacgtcaacagggacagcttctccagggtgctctggtacgccgtcaccaactaccgcacctggatcttcgtcctcctctacggctactccatgggcgtcgagctcaccaccgacaacgtcatcgccgagtacttctacgatcgcttcgacctcgacctccgcgtcgccggcatcatcgccgcatccttcggcatggccaacatcgtcgcgcgccccaccggcggcctcctctcggacctcggcgcgcgctacttcggcatgcgcgcccgcctctggaacatttggatcctccagaccgccggcggcgcgttctgcctcctgctcggccgcgcatccaccctccccacctccgtcgtctgcatggtcctcttctccttctgcgcgcaggccgcctgcggcgccatcttcggcgtcatccccttcgtctcccgccgctcgctcggcatcatctccggcatgaccggcgccggcggcaacttcggcgccgggctcacgcagctgctcttcttcacgtcgtcgaggtactccacgggcacggggctggagtacatgggcatcatgatcatggcgtgcacgctgccggtggtgctcgtccatttcccgcagtggggctccatgttcctcccgcccaacgccggcgccgaggaggagcactactacggctccgagtggagcgaacaggagaagagcaagggcctccacggtgcaagtctcaagttcgccgagaactcccgctccgagcgtggccgccgcaacgtcatcaacgccgccgccgccgccgccacgccgcccaacaactcgccggagcacgcctaaggcgtaaacaattctgcgaccgagaccagcaatacgctggagttcgactcgatgataacacgccggagcacgtccttgttgcaaacggtgatgaaattaagagtgaaatatttccttaggaattgaatcctttgaaattaattcctttggaatttctccgatacaaacggaggtataataagggagaggcatttatacctatgtacatgttacacttttttgaatttacagtgtattccatattgatgttgtcatattgacactccagctgaaaataataggagtactgtcctgtggttgaactacgcaattattttgcatacaaatttcaaaaaagcggcgagcaatacatagttgagaaattcgttagttacatcttatgatcagggccggggttaaaatttgagccgctaggtgggtccagttagtcaccaggccagtaactttggtaaaaaaaaattaacctgtcctaagctcctttctatgctttcttcgtattaaaatccaataaaattcatgcgtttgaaaggagtactgacggcataaagtgtgcgacattggcactgctctcctttctattccttctatcccataatataagaagttttagagttatgtcggtgatataggcccgggggtatgtatcaggtttagagggaggaggctgccccccgatgccgcgtggccctcccccaaggggagtcaggcccgaggtggggtggcggccactctttccccaaagactagtcagaggaggctaccccccgatgccacgtgcccctcccccgaggggagtcaggctcgaggtgggacggcggccactccttcccagagactggatggaggaggctgccccccgatgccacgtggccctcccctgaggggggtcgggcccgaggtagggcggcggccactccttcccaaagactagtcggaggaggctgccccccgatgccacgtggtcctcccccgaggggagtcaagcccgaggtgtcacaccccaatctggcaccgtcgtacaacggcacctgataggagcgtgtcgtaggaaaaacggtgcaaaccgctccctacgaaaccgcgatctcagtaccagtcccaggacatagcgctggtacccacggtgacaaatatgaatcattgcaatccttaaaataaatagaggacttatttaccttaacttaggttgcagctcagacagcctaagaatgcaaccgacgacacggacgaggcaaacaccaacaacagcagcag

SEQ ID NO: 807 - DNA, 4086 bp, Oryza sativa
cttctaccatcccacctactctcaacacataaaacgagaagttttatttcttaaataccttttacttacttatcaccgttactactttttcaataataataaggattttgattatttttacttctcactcaaattatcttgagatgttaggagtgttctttttatgggatggaggaagtaggcaactaggcatactgttaatatagatatgaaaagatacaggccgttcactgcactaggcatacaagaacacataaaacagctcgtctcaaagtataattgtgttaaacgtgagctgatctcaccgttccaaaattaaaatgaccacaaagtcaccaacatgttagtgttgcatagtttagttatccgtacagtactcgccaatcagaggttatcatgtcgtagcactattgtcaactagactggagaaggagaagagctaacggcaagtactatagttatttaagcacaatctcctagatgccatctaattttaaatgatgatgtggagaagagagtagatgagagagaggatgagccatccctcatacaagggacaacctctttacaaactttaaggaggaaggagaaaagagtgaggttgattggatgagagtgaataaaataaatatttatgttgcattgagactattatatgagctgtccttaataaattagttgatgatatggacaatattagatgtgatagtcatctctgccataaaacttgccataatagttggagacttggtggcattccgggggaacccaatccaaatccgcgacgaattcctctccgccaatacagtattcgtgtgtgccgaggagggaggcagttccacaggccaaggaacttacgtgacctccaaagtcagaggtcggaatctcccttcgttccagccatggcccaccacccttgcggcttggtgaccctactgcgccgccaagtcacccgctcgccaacaaaaacccgcgacgcgagcgcggagacggcagcgccggcctcccaccggtcgcgtaagatcacgcccgaaatctttattcattttctctccaccggttgccctctcgccgcacccaaccatcgcgccacgccgcgccgcgctgccggagccgcgctttccgctatgctataagagctgacgcgcagggcacagcggatgtacgtacacacagtcactagctaagctgctagccttgctaccacgtgttggagatggaggctaagccggtggcgatggaggtggagggggtcgaggcggcggggggcaagccgcggttcaggatgccggtggactccgacctcaaggcgacggagttctggctcttctccttcgcgaggccacacatggcctccttccacatggcgtggttctccttcttctgctgcttcgtgtccacgttcgccgcgccgccgctgctgccgctcatccgcgacaccctcgggctcacggccacggacatcggcaacgccgggatcgcgtccgtgtcgggcgccgtgttcgcgcgtctggccatgggcacggcgtgcgacctggtcgggcccaggctggcctccgcgtctctgatcctcctcaccacaccggcggtgtactgctcctccatcatccagtccccgtcggggtacctcctcgtgcgcttcttcacgggcatctcgctggcgtcgttcgtgtcggcgcagttctggatgagctccatgttctcggcccccaaagtggggctggccaacggcgtggccggcggctggggcaacctcggcggcggcgccgtccagctgctcatgccgctcgtgtacgaggccatccacaagatcggtagcacgccgttcacggcgtggcgcatcgccttcttcatcccgggcctgatgcagacgttctcggccatcgccgtgctggcgttcgggcaggacatgcccggcggcaactacgggaagctccacaagactggcgacatgcacaaggacagcttcggcaacgtgctgcgccacgccctcaccaactaccgcggctggatcctggcgctcacctacggctacagcttcggcgtcgagctcaccatcgacaacgtcgtgcaccagtacttctacgaccgcttcgacgtcaacctccagaccgccgggctcatcgccgccagcttcgggatggccaacatcatctcccgccccggcggcgggctactctccgactggctctccagccggtacggcatgcgcggcaggctgtgggggctgtggactgtgcagaccatcggcggcgtcctctgcgtggtgctcggaatcgtcgacttctccttcgccgcgtccgtcgccgtgatggtgctcttctccttcttcgtccaggccgcgtgcgggctcaccttcggcatcgtgccgttcgtgtcgcggaggtcgctggggctcatctccgggatgaccggcggcgggggcaacgtgggcgccgtgctgacgcagtacatcttcttccacggcacaaagtacaagacggagaccgggatcaagtacatggggctcatgatcatcgcgtgcacgctgcccgtcatgctcatctacttcccgcagtggggcggcatgctcgtaggcccgaggaagggggccacggcggaggagtactacagccgggagtggtcggatcacgagcgcgagaagggtttcaacgcggccagcgtgcggttcgcggagaacagcgtgcgcgagggcgggaggtcgtcggcgaatggcggacagcccaggcacaccgtccccgtcgacgcgtcgccggccggggtgtgaagaatgccacggacaataaggtcgcggttgtagtacaactgtacaaattgatggtacgtgtcgtttgaccgcgcgcgcgcacagtgtgggtcgtggcctcgtgggcttagtggagtacagtgaggggtgtacgtgtgtcgtggcgcgcgcggtcacctcggtggccttgggattgggggggcactatacgctagtactccagatatatacgggtttgatttacttctgtggatcggcgcttgttggtggtttgctccctgtggtttttgtgatggtaatcatactcatactcaaacagtcaaaactttttgatgtgatatgttggtatcagtgtttctattgctaaagtcgttgattcgctgggaacagtggctcgaaatgtgaaagtgctccggctttatgagctgcagattctttcgaagtctgaagaacagtgtcaagcttcagcttttgttcggtcaaaataggactatcattataccaaattaaagtattggacaaaacgtcatctaaatgaccattagagaggcatttgatttagttgagtagtataaaataactagcgcgacttcattctcgcggcatagttgaggtgatattttggcgacggacaatccccctcctcacactcgacgtacatagcatgccctactcagtagtcagtcaacaccctgcaactgttgtcgctcaaaaaaccgcgtacaaaatttgaatatctatgaaatccatggtaaagtttgaatatatacacaaagtttagaatctacggatctgtgccagtttcaaaatatgagcattatcaaaacaaacccgtgtgcaaatagacctcacatgaacgtgcaagggaatagtagattagtaggatagtatgtccgtcaaccaatactcaattatttttcttctttgtatttcagtctattgtagtacagtacggagtaatttgtaaaactccagtacgcacactctctcatttttgagagagagacgaaggtctcttctaagctgccatacggcccatacacacgcgaaagaccgataatcagagcccaccaaaccatggaatagcagcccaagtgtagcgcagccaccatttgcgttccacacggcctaccccatcgcgcggtgcaaacttggcccagaaacaccgagcacgatgccaccgtgcgcgtgtgccgtgcctgccgtgtgcgtgtgaggcggtgagcgcaagtgtgggaagcgaagcgaggcgagcaaaccgcgagtcgagtccgcgacgacgttcgcgcaccaaccggccacaccgcacttgtcccgtgcctgcgttgcgttgcgcccgt

SEQ ID NO: 808 - DNA, 6076 bp, Oryza sativa
ttcgttaatttggggaataagcgaaacggcttatttgtaaataaaaaataatttataaataaaatttttatatcgtgttcttagcgatttaaaaataaaggttgaaaaataaacttcgatgaaaaaaatctcaaaattaactctaaatttaaattttagccgataagtataagcataatctgctcctgcttgggaggatcatgatgtactactttgattgcgtcaattttactccttccgcttgagcaaacggcgatgataaatttatttcacagccctcgcagccatgcatcaacacgtaattaagtactagttgacagtgaaagaaaacgtagttaattgcgtcgacatactgtagaactgtcagctcctatataagtagaaccacccacccccattaagttatccactgtcttattctgtccacgtcattaaacaaagccacaaaaaggccttcgcggcctcttgcatttctgcaggtcgcggagcgggtgcaccgaaatttcccgtctcgcgtcgcgaactaacttaaatataaccatcacttgctaatactttatccaattatctagtagttcttgcgttctctcgtgagaatctcatcgcgtgatgatttcgggcagtggaccggtgtcgcgcatgtgcgcgttaataaccatttgatagccacgaatcaattagaacatgtacaatagcaggctataaaccagctataaccacatatcgagaagaaaagagaagagagaagaaagcggactatagatttatagccggctgcaacacggactccaatacgttatgagtatataagagataggaccgaatattaatgatgtagtatatttttatagataactattatataaatgggctattagattgactataaatgatttggagcccagttggctatactattgaacttgctcttaacaagtactacaactgcagcgtttgaaccgatctcgcctcgctctaataacacttcatcttccgagttccgattgtccggggttggtgagttggtctgttggtggccggggcgcgggcgcgcttacctgttctccctcgcgtggagctctttgactacgcccgccagctgcgcgtgtgtataaccttgcttgcttgcctctcacagccgaagtcgcaggcgcagtcaggagctatcgggaaaacgggatttcccccagctttccaaggttcgcgggtcaatctcgcagtgatactccggcggcggcaatggacgccggcgaaatcatcgtggcccagccatcgccgcggctgtataaggtatgtgaaacttcatgagcgagctcgccgtcgacccaagcttagggagatatagggattgatattatcggtgcagcagtgcgtgattagttgtttagtttagcttgcttcttaatttgagggctttcatttggagtttataatctgattgtttggattgcttttgtgcagagtttgactttccggaggatcgcgacgaaggaaaggaccattccccaggatgaagagatgaaggtaagcacctcttgatcacgtttgaactcgtcctctgttgttaattagtcattaacttgcgtagttgtagtccgtagtaatagaaaaacttggcgggcggggtgcgatgtgtgatgatctgctgcaagaactgagaaatttttgcgtcaaaaaggaactgagaaatttttggataatggatcacataactcgtcttctaaactctaataaatggatgtatacgaccattttgtgcattcgttttagtaaaaaaagcagctacacattgttttcttgtttttgctagtactttaatatagtatacatgctatattgttggtttattacggattccatttttcaggtgtcctatggtaataattttcgcaagtgtttttttttgaattcatcactgcagacaacaagaaatatgatttaatggtcaaattgattaccctgcaaattgtgttgtgacaataaaatgatattctcaatttcaagaggccagcatgcaatttctactatcataaaatagtgaaattaattgaccgtatcaagaactgtacacaactgttaggtttttcaagttattgtactagaccgtatccacctgccagatttttgttctaaaagcgtaatttattttatattaagctattatcaatatctcgatgcaaatgtgtgttcttttttattaaaagattctttcactagggaaaaacgtccggccaatcaatttgtcccagcatagtcgccctatgggctatttttataggccttaggcagccgtacgccctgttgaaaaaaaaaaagactcccagctcaaacccagcccaaaacatctgttaatttggttttacatgtaaaatcattgggagcccgtagattcagaaacaaaggtctcaaattggatatttttcttaatttttatattatttcatattatttctaaaagattaaaaaataaattacagttttaaagttttgcaaaaatttactcctcccgccctaccgtagagcgatatatgtgacatggcaatccagggagggggtgccgtggcaattttgcataaatcgccctcccctaggacgatttattcttgagaaggagccatctataaaattgtcatgacgcaaaatttagtgatgcatcgggtgcgttatggcaattttacaaggctcccacccgaggagaaatcgccttcctgtaaagtgatttatctttcaagggggccacctacaaattgtcacggtatacctcccacggggtgccatgccacatagattgtcctattgtaaggtgatttataagtccacttttcgatatgtaaaattttaaaatgataatttattttttaattttttttaaaaaaataaacaaatcctcaaattgtgcaatcttttgaggccttatttcgttgcaaactttttcttcaaacttctaacttttctatcacatcaaaacttttttacacacgtaaactttcaacttttctatcacattgttttaattttaaccaaactttcaattttaacgtaaactagacacatcctgacttcgttcgcagattcgcagcccgaggttccaggacgaaagcctcactgcgccatttatactagacaagaaagcgaggagcaaagcgccaacagtggtcctaggattcgagtgcttggagagcacagcatttaacggcattgccacgaacctggtggtgtacctggagactctcctgcacggcagcaatctcgcgagcgcgtccaatgtcacgacgtggttcgggacgagctacctcaccccggtgttcggcgccatcatcgccgacacgttctggggcaactacaacaccatcctcgtctccctcgtcttctatctccttgtaagcatcaatgcattttgcaagatagtatgttgaaatccatatgtccaatgtgcttaattaactttgcaatccatcgtctgtgtgcagggtatgatgctggtcaccttctcggcgttcctgccgaccaccgcgctgtgcaccgtggtgggctcgtcgtgccagcagccacttcttggcgcgcagaccatcgccttcctcgggctctacctcgtggcgttcggaagcggcggtgtgcgcgcggcgctgctgccgttcggcgcggaccagttcgacgatgacaacacggccgaccgcgagcgcaagatgtccttcttcagctggttctacatctgcgtcgacttcgggatgatcgtgtcgggccttttcatcgtgtggatccagcagaacgttagctggggacttggcttcggcatcgccacggcctgcatcgcgctcgccttcggcggcttcgtgctcgccacgcccatgtacaagcgccgcatgcccacaggcacgccgatcaagagcctcgcgcaggtcgtggttgccgcgtgccggaaggcaagactccgtgtccccgcggacactactcttctctacgaagtccatgacaagatcaaccagtcgaagatagcgcacaccgaccagttcggctttcttgacaaggccgcggtggtcatggagtccgacttggaagaggaatcgaacgacgtcgcggcggatgcctcgtggaggatctgcacggtgacgcaggtcgaggagctcaagatcctgctgcggctattgccgatatgggcgacgagtatcgtgctttcggcggcgtacgcgcagctgaacacgacgttcgtgcagcagggcgccgcgatgaacatgcggatcatgtcgttcaccatcccgcccgcgtcgatggtgtccttcgaggtgctctgcgtcctggcatgggttctcatgtacagctccgtgatcgtgcccatgctcaacagcttatccctggccaacggcgagccgtcgcagctgcagcggatgggcgcggggcggctgctcatggcgttcgcgatggccgtcgcggcgctggtggagatgatgcggctggacgcggcggggcgcggcgagtccctgagcatcgcgtggcagatgccgcagtacttcgcgctggccggcgcggaggtgttctgctacatcgcgcagctggagttcttctacagcgaggcgccggagtccatgaagagcatgtgcacgtccctggcgctgctcaccgtggcgctgggaagctacatgagctcattcatctacgccgtcgtgaacgcgttcaccgccgtggacgggcggcccgggtggatatcggacaacctcaacgaaggacacatggactacttcttctgggtcatggcggcgctgtgcacgctcaacttcgtcgtgtacagcgcgttcgcccggacctacagggtgaagctggtcgtgtcgtgattgttcgttactcccttaccatgatcaggttacacgcaatcgtggtcgtattgtgttacagaagaatcttgtactcctagctagcaatagcgacagccgacagtatgtgtaaagttcaaggaaaaaaaacaaggtttgatgggctgacagcccagcagcttcctttatgggccgtgtgcttgccaccggggctgatcggtccaaaaggctactccaataaaaggaaaacgtccactttgattcgtaacgtttaaacccaaaatcgggtataaggactctctcaactattaaaatcgattaaaaatagcccctacaataatactattaaggatggtatttgctgatgtggcatgctaaccataatcaaaaccacgagttagtaagaaaattgggaatattacatggagtcgacatgtcattctcactattctttccctttttatttccctccctctctgctcccatatctctctctcctccctctttcccgtcggcagtagagaggacaggagcgatggcaggtgctcgaggatggtggcagtaaccaccagcattggtagccataggtgtcagagaggtggatggggaacaggcgacggctgaagaaacaggcagcccaatctcacctgatatgcccacaccgctcctggcccataatccccataatcattatggtcacaacgatagctgaaccccgtccatgagaagttcacctgcccatccatggaaagaaaggaagcaacggtggtggtcggaaggtctctttgagctcaagctcatctccttgtccccatcgtcggtgaggcccttcaagctctgggatccggcaacaaaagaaaccaagctactctggctctgaatggcactcgatggtaaagttcctgactagtcacgcatccagagctcagacaagcccatgcagtagtcttccgatagaagtgcatagggtggccaaatccatcacgtcctagatcaaggaggcaccaactatggggaccgaggcagttcgaccatgctttgcatgggtctctgccgccggcacctacccatagcccaacgtcctcctccctgaagccacccacgtcgctttcttcatcatcttcccctctctattgcggtttgcgacaaggcccacgagcaagaatgggattgagcgagggtggcgacggtaacctgaggcctggcggagtgcgacgatgccaacattgtcgaaggggaggcaaagcggcagcgtggagcagagcgaa

SEQ ID NO: 809 - DNA, 5266 bp, Oryza sativa
aaaaagttagaagtttgaagaattattttggaactaaacacggccttagtcacagcacatgggttgctatcattaccatttaccaatgaaagttaggtcctgtttagttccaaataaaaatttttcacctgtcacaattatgcatggagtattaaatatgaaaaaaaaattacacagtttacgtgtaaattgcgagatgaatctcttaagcctaatagcgtcatgatttgacaatgtgatgctacagtaaacatttgctaacgacgaattaattaggcttaataaatttgtagaatatgtaattttttttgttattagtctacgtttaatacttcaatgtgtgaccgtgtatccgatgtgacacgctaaaaaatttctcgtgaactaaacaggcccttaccaaacttgtcaaaggttgtgtgcttaacatcattgccacgcctgaaatactttcaccacaccttagcaagttcaagaaaatcttagcaaaaatttccaagttattgatgtatgagatttattttgttggaagataatcttgttataaccatatagagccaaactatctaagttagtcaccagaatatatttcagtgtgacaaaaagtaacaggcaactagacgaacccatagtgtaattcggatcaggtgcagttgcagtagtaactgcaacttagcaactgcatgcaacatcggccgtccatccattgtcaccagataccattcatatacaaattttaaccattcattagcaacagtttcatatttaaagtcatcgaagtaccttatatgcttaatataagtttatatactacttgcatctatcaaattacacgataaaatttagatgtttttagtggttgatagaaatgaaaccacacgggtcaacgctaaggacaagggaacggaggtagtatcacggcactgtgtaggtcagaaatatctgcttctcgcatacaagaaacaaaaggaaacgtccaagaataaatcggtgcggatagtgacactactgactaaagaaatcaaaaggaacaagggatttctcagtcttgttcaagaaatagacgctagtacagccagcaacaataatttccgaggcttcaatgtcgcagaaaccacaattaattatgcatgccgaggtaattaataatatactccttcgtatctaaattaacttgtatactaatctttattcgctttattttccttttgggtctctgatagagttggtacgggataaggttgtcctgtatatcctctcgaggtcttgattagcttgtacagtttgtcctcgagctctcgaccggctccggcaatggcgtccacggacactgagcagcaggaacacgcagtggcgctgctacaacccgaggtaattaattaatcgctgttcataatctccttactgctagccttatgccgatttccacgatgcagtttgtttaatttctcatcagtttccctgcagaaaaatattgattgagccttgcctgaactagctactcctagttaatttgaagcagccgctcatggatacgttcagtgctaactaggctggggattttggttgctgcaggttgaagaagcatacaccactgatgggtctcttggcgtcgatggcaacccggcgctgaagcatcgcacaggcggatggatggcatgccgcccgattcttggtaataaacttcattagatatccctgcagctctattaattatttcctaaccttttttacttgccaattttttgatgattaatgtgtctctcactttgtgtgttcttgttccaaaaaagaaaaaaatgaaaaaaaaaataaatgaggaacttctttgttgatgtggttatctgagctatgacaacactgaggagagatgcttattctgcttgctttgtgattgtggataggcaccgagttctgctactgcctggcctactacggcatcacgttcaacctcgtcacctacctcaccgccgagctgcaccagagcaacgtcgccgccgccaacaacgtgtcgacgtggcaggccacctgcttcctcacgccgctggccggagccgtcgccgccgattcctactggggaaggtaccgcaccatggtcgtcagctgctgcatcggcgtcgctgttagtcccctccatttcattcgatccgggttgtgtttagttccaaattttttttttcaaacttctaactttccatcacattaaatttttcatacacacaatttttttcagtcacgtcgtcttcaatttcaaccaaaatctaaactttataccaatctaaacacagccttaattagaattagtcactgtgtccttcctgccgtgaatttatggctgatggcaagtaatcagtcactgtgtgggatgtggatttttatcccttgagagaacatttaattttatattaatattaatttatgttaatttatgttgtcatttaattttatattttatattaatttatgttgtccattttttttaatttttttatgactaattagttggcatggatgaaacgagggatatttcctggagggatgaaatcactttccccactgtgtgctgccatgaatgcaaatccaatcagcttcatggctgtacgtacctaatctgtggtgcagggcatgctcatggcggctctgtcggcgcttctgccgctgctgatcaaggacacgtcgtccatggcttcagctcaagtgatcatcctgtttcttggcctgtacatgatcgcatttggggtgggtggtctccggccgtgcctgatgtccttcggcgccgaccagttcgacgacggcgacacgtcggagcgcatcagcaagggctcctacttcaactggtacatcttcaccatgaactgcgcgtccgtgatatccaccaccgccatggtgtgggtgcaagaccactacgggtgggcattggggttggggattccggcgatggtcctcgccgtcgggctctcctgccttgtcgccgcgtctcgggcgtacaggtttcagacaacccgcggtagcccgctcaccagagtctgccaggtcgtcgtcgccgccgtccgcaagttcaacgtcgcgccgccggccgacatggcccttctctacgacctatcggaggatgcctcctccatgaagggagttcagaggatcgagcacaccgccgatctccggtcagttcatgtctctcgttgcatctggtgtttgtgatgctgtaggtgtaatgtaattggctaattcttgagatgcaactgctcgatcagattcttcgacaaggccgccgtcgtgacggcgtcggacgaggaggcggagggcgccgcgccgcgcaatccatggaggctttgcgtggtgacgcaggtggaggagctcaagattctcgtcaggatgctgcccctgtgggcgtgcgtcgccttctactacaccgcgacggcgcaggccaattcgacgttcgtcgagcagggcatggcgatggacacgcgcgtcggctccttccacgtcccgccggcatccctggccaccttccagatcatcaccacgatcgtgttgatcccgctgtacgaccgcgcgttcgtgccggcggcgaggaggctgacggggagagagaagggcatctccgaccttctcaggatcggcggcggcctcgccatggccgcgctcgccatggccgcggcggcgctggtcgagacgaggcgcgcccgcgcggcgcacgccgggatggagccgacgagcatcctgtggcaggcgccgcagtacgtgctggtgggcgtcggcgagctgctcgccaccgtggggcagctggacttcttctacagccaggcgccgccggccatgaagacggtgtgcacggcgctcgggttcatctccgtcgcggcgggggagtacctgagctcgctcgtcgtgacggccgtgtcgtgggcgacggcgaccggcggccggccggggtggatccccgacgacctcaacgaggggcacctgatcgcttcttctggatgatggctgggctcggttgcctcaatcttgtggtgtttacgagctgtgccatgaggtacaaatccaggaaggcctgttgatacttctgggcttgtttggtaggctcgaaattccggcccatgcactctgacgggccattatgtatgggaataagtccatccgacctccctcatctcttgcacttggtcgaatcgcatccctcagccgcaaaaaactgggtaaaacgcctcctgaatctcccaaaaccggtgcaaatagactcctcgagtggtttggaaggtggtttcagctgacgtggcacattgaccgtgattgactagctgaatcagcaactaggacccacatgtcatcctaatattatcttcttcctctatgtcaacccgtggcagtgccgcctcctttgctatcgcatgcgcgcactcgctcaccgccatccccgagaggttcgcaccgagctctccttctacgagctggtggtcgtggccaccaccaggaaggggtttacgcgcagatgtgcacaatgttcctcacctctccctttctcgcgcggggagcggcggcggctgcgccgtcgctgttcgtgacggcctcgattggcgtggtcggagctacaatgccaccggcgccctcggggggctagggtgcaagtgcgccgatgcatgtgcctgagccagcgggaggacgacaagctcggtgaagaggcgctcggcagtggtgtccgattagttggcggcagcgacccagatgacggcggcgccaacatcacaaccacctccccaacgtgtcgaaacaaattttcggtaatatgaaaagggggtagcgtacgagacctaaaagtggatggatgcagatacagggatttagacaggttcaggccctctcaatgagaggtaataccctactcctgtttggggatttgaatccaccgggtgtttatttatctgacgatcaggttgtctcatgccccctagagggcctcctgcccaccttatataggatgggaggcaggattacaagataaaaaccttaaccaacacggtatcagtttcctaaatctactttacaatattaccaaactaggactttaggccgttctgtaatatacaaggaaacgtaatacccaagtcatgaactgttacatattccataaatataagttatcccctataactagtcggataaccatgccgtgtgggtatggggtacccataatctccacagtagcccctgagaccttcacagtcgaaaagataatcttctctcgaactagattactccaaagccgagt

SEQ ID NO: 810 - DNA, 2987 bp, Oryza sativa
agaagctactgcttgattttaattctttagtgcttgaaccatcataaaatagccgcaaagattaaaaaaaaaacaacaacacaatatatagagaccatcatagtaatttgatccttccactttcacttttgtacgaagctgctgcatttctgctgtctaatcaacattctataaacaacatcataatgttctctcattacacaactgtaacctagagtatcagccagcttgggctaggatatagacctaaatttcatcaatgagtgccacatcgaatcattttcacttacgtgcattgttttggcccgagtttgcacgagataagcaagtcgttctatctacttcacgtaacatgtgagtttgtgcactgtgagtgcaatttactcaaaataaattgcatcatcatctttttgtgatactccgtggtttcgaaactattaagattcagatagttgtattgcatagtttcaaatataaacaaatcacattttttttttgtgtgtgtgtgtggggggggggggttaaattatggtgttccatagtttcacttgacaatttcactttaaattcaaatttaaaatttggagcctttaagtttgtgaacaaaagtacgagattggtcctccacaaattgaatcatgtgcatgaagttgtcacaggctcacagcgactgcacaacagcagctggagtaacacaaaaaaggccatttttatcactatgccattcatatgtattaaattatctctactctttctgttcgagtgatttgaacattttcacatccaggtataatccatgctaacaccaggacgtgttctcatttcagctataaatagcaaaaaaaattcaaatatgtataaacccgtcaccgttctcatccaaaattatctactttcccgataatttcattttcattaactccattcccgatcagtgagattttgctacgcattgttattgatataaaaagatggctataccttggatgcgagtgtggccatggagcactgcaatggcatcgccgccgttgggcgctggttgtccaccaagcccaaggttatcttcgtgctcggcgccaccgccaccggcaagtccaagctcgccatccgcctcgccgcgcgcttcgacggcgaggtcatcaactccgacaagatccaggcgcacgacggcttcccggtcatcaccaacaaggtcaccgacgaggagcgtgccggcgtcgcgcaccacctcctcggcggcgtcagccccgacgccgacttcaccgcggaggacttccgccgcgaggcggccgccgccgtcgcccgcgtccacgcggccggccgcctccccgtcgtcgccggcgggtcgaacatctacgtcgaggcgctcgtggccggcggcggcggcgcgttcctcgcggcgtacgactgcctcttcctgtggaccgacgtcgcgccggacctgctgcggtggtacacggcggcgcgcgtggacgacatggtgcggcgcgggctggtgggcgaggcccgcgccgggttcgacgccggggcggactacacccgcggcgtgcgccgcgccatcgggctacccgagatgcacggatacctgctggcggagcgcgagggcggcgccggcgccgaggacgacgacgacctcctcgccggcatgctcgaggccgccgtgcgcgagatcaaggacaacacgttccgcctcaccgtgtcgcaggtggccaagatccggcgcctcagcgcgctgcccgggtgggacgtccggcgcgtggacgcgacggcggtggtggcgcgcatggcggagggcgcgccccacggcgagacgtggagggaggtggtgtgggagccgtgcgaggagatggtcagccgcttcctcgagacgcccgccgccgccgccgccgtcgttgccaacggcaaagtcgacgtgaacgtcggcgacgcggccgccggcgtgcctgaggctgccgccgccgccgtcgttgcggcgggtgtggtctaactctaagtaggatacgcggcgacggtgcatgtttgcatggtgggtggcggctcatgttgcggttttgggttggctttggcgtggctgggccaggtggcttgcaatatttcattatttatttatttttattttgagctgcagtgatatgagattttgagtgagaaaggagagggagggagacacaagtatctttgagcttgtttaagcttagtgttacaagagattattttgttatgttttcagaatatataaaatgctagcgcctctagtataatcggtagtatttgacaccgcacaaaatagtagagaatgctacgcagcgtcaaatattaccagttgagggaatacaaattctaaagtgtttacttgtcttttgatttgaagtttaaaaccaatcgaaattcttaactgtcttttgaaattcgaagtgttttctcccttattagggcctgttcggaacaaaaggataaaaaacacagaaatatgatagagcgtaaattggaaagctcagggactgtaaaacttgagctgtttggaacagaggaatgctaggggatagatacacaagcacacaactaatgtgaaggaaaatttcctttaggaggaaccttatttttctttgtttccttttaaagtatatgatttcaaaaaacaatatttggagggagagatgtccctccaaacaatttttaagaaaaaaatatgagcgtgttggagattaaacacggagttcaaacaaacaagatttggagggagagacgtccctccaaacattttttaagaaaaaattatgagcatgttggggattaaacacggaacctcagggttgaaatcatacatctcttgtcactgcactatcaagtacatctcaaagtacagagtttctcaatgctcttttctttgatccaaacaacatcataggaagattttccaaaggaaactaaacctccacaattcctttaaaattcctttgatccaaccatgccttggttactgcata

SEQ ID NO: 811 - DNA, 6577 bp, Oryza sativa; identical to SEQ ID NO: 410

SEQ ID NO: 812 - DNA, 3177 bp, Oryza sativa
actaatattaatgagtgttgagggtagtagagatgcaactttaccatactccctttgtttcagattataatatgttttgactttggttaatatcaaactactttaaatttgactgagtttaagcgcaaatatagtaatatttataataccaaattagttttattaaataaataattgaatatattttcataataaatttgtgttgtgttgaaaatattattaactttttctacaaacttggttaaacttgaagcagtttgactttgaccaaagtcaaaacgtcttataacctcaaacggagggagtactttttttgtgggaacaagtttacaatgtttaataaaagcacaatccatcttaatgttttcaagctgaatattgtaaaattcatggataaaccagcttctaaatgtttaattgggaaaatgtcgaatgacaaattaatatttttaagtggagggaagtattaatatttcaatatcgtactaaactgtgggatttattttctaaaattttataccctgccaattcacgtgttgtagatctttttttttcactaaccgacaccaggtatatcaattttattgaatatagcagcaaaaagaatgtgttgcacttgtaaacaaaaagcaaactgtacataaaaaaatgtactaatgaagttcataaagatgctttgcttaatgagggcccaaagttttgatgaccttttgcttgatctcgaaattaaaattcaagtactgttaagggaggtcacaccaccatcaattttcagcctgaagaaacagttaaacaacgaccccgatgaccagtctactgctctccacatactagcagcattattgatcacaaaagaaaccaaaataaaaatcagcaccgagtgtgcagagggagacaaaggtgatctggcagtggatatctccccatccatcctcacccgcgctgcccatcactcgccgccgcatactacatcatgtggagagaggaagacgaggaccacagccagagcccgggtcgagatgccaccacggccacaatccacgagcccggcgcgacaccaccgcgcgcgcgtgagccagccacaaacgcccgcggataggcgcgcgcacgccggccaatcctaccacatccccggcctccgcggctcgcgagcgccgctgccatccgatccgctgagttttggctatttatacgtaccgcgggagcctgtgtgcagagcagtgcatctcaagaagtactcgagcaaagaaggagagagcttggtgagctgcagagatggccccctccgtgatggcgtcgtcggccaccaccgtcgctcccttccaggggctcaagtccaccgccggcatgcccgtcgcccgccgctccggcaactccagcttcggcaacgtcagcaatggcggcaggatcaggtgcatgcaggtaataacctactgacccaacacacattattcttcttcttcttcttcttcttcttcttcttcttcttcaacattaaccaataattcaattatcgtttatttaggtgtggccgattgagggcatcaagaagttcgagaccctctcctacctgccaccgctcaccgtggaggacctcctgaagcagatcgagtacctgctccgttccaagtgggtgccctgcctcgagttcagcaaggtcggattcgtctaccgtgagaaccacagatcccccggatactacgatggcaggtactggaccatgtggaagctgcccatgttcgggtgcactgacgccacccaggtgctcaaggagctcgaggaggccaagaaggcgtaccctgatgcattcgtccgtatcatcggcttcgacaacgtcaggcaggtgcagctcatcagcttcatcgcctacaagcccccgggctgcgaggagtctggtggcaactaagccgtcatcgtcatatatagccttgtttaattgttcatctctgattcgatgatgtctcccaccttgtttcgtgtgttcccagtttgttcatcgtcttttgattttaccggccgtgctctgcttttgtttttgtttcacctgatctctctctgacttgatgtaagagtggtatctgctacgactatatgttgttgggtgaggcatatgtgaatgaaatatatggaagctccggctatatatatttatacaaagggtacgagatggatgtgaatcctagagcatatgtgtccaacaatcaattcgtcgacaatgaaaatttgatcatggaattaaaaaatcatgcttctgttgttcatcggaaatgcctttctatactgattagtggatttccaaactgaattcacaagaaaacatatataattgttgtgttcatcaatctacttcttttgatcaaataaaagataatttgacttggcaaaaaacaaaaaatacagtttttcaggtatggagggagtactttttttttttcaagattgtcacatgcaaataggcaataatacactctttttataacttgtaagtgtttttttaccttttttttgctacatattaaataccaaaacagtgtatcgaaaagcaaatctgtacgacgaccaaatggctaagtggtgtaattgtgtgtcagtccagtccaagtccaacagaaaggttggcagatgataccccaacggtgttgcgctttctttttgtccataatttctatttctagtttttttttaaaaaaaaacaagcggtcagttaataaaatacggttggaccaactgctttctaattttatcccaaaagattgctctccaatggcaaaaacgtaaaagcaattctaaggcccttcacaatgcggggacgtggaccggtgctccaccgcgctagctaggattcgcgcttgcgtggcgtaaggttgcgcgtcccaccagaggcgctcgctcccgcggagggaagcgcgcttcctcgctcgcgctggagcagagtaacggctggagcctacactgtggagagcgtgcctccgactcgccgtcacctcgcgccctcccgctccgcgtcgccgacctcatcgtcgtcctgggctccgcttcgcgctgccgcctccgaaacctcatcgccggccggaagtggagacaaagcgaggaggacgacgaccatgagcagctccgtctcctcgtcgtcggccgagagaggaggagcccagatccgctctgccaccatctccagaa

SEQ ID NO: 813 - DNA, 5878 bp, Oryza sativa
aagcatgtatatcgcccgctttacggctttagacgctagcttatctagtacgcagaatatctgacggacgcagaggattgagacctggaagctaggctaaactaaacaggtagcgaaacgcaaccctttccttgacagttatccgattacgcgcctttctatcaggcacagcagcacgggcagccacaagattcaactaaaatttagttaactgcacgcctctttttcgtttacgtcgccgtcgccctatccaaattcgcccacgtttgatatagatgcataactgcaaagcgagaattccatttcttcatgcgtcaattggtccctctcgtcttctcctaggccacactattcttgaccatacctatgaaatcacaaaacgtatacgaccttatttggaacaagtttttatcaataaaccctttttgattttatacacgacaggaaacaattattctaaaattttctctactgtattgctaaccacttattttagctagaactttaaaaattttaatatattctcataattaagtagataacacgtgacaataatataaatcaaacgatttgacaagttttccggaaggaaaaaaggctgcaaaagccgatctggctgagtgcggttgtgtaactgtaacttttttcttctaatatatcgacgtacaatcgtttttgcgcgttcacgaaaaaaaagctgcaacctgcaaaattcaaaggtttgcgtgggagcttagctgaattccgccgatcaaattctgtttccacaaaaattgtccgctccgacggcgtccgcgcacacgcgcacgcacgctccccgcgccacaaaaccgggggaaaacgagagaaaaacgcaacgaaacgctcgccccgcaccgcacggaacatcatcatcatctcgcgctctcacgcggaccccgccgttgcggccgcctcacgacgcgagcgcgccacatggacatccaccatggcgccaccctttcccctctcctcgcttgtatatattcggcgcgatgccgtcgcagccggtgccttcgtttcaccctgctcggaaaaaaaatcctaaaagcttaatttctttctttgttcttattactgtctcacgtgagacgcctgagctcaactgaatttctggccccctcttcatctccgtgagcttcgctgccctttttctttgccttctcttggtggtttaatttcatcagttttcctccatttccttctttagccattgttccgattgccgtctcttgttgcatgtgcattccttctctgaaccgtgcccccccaattcgtccgcgagctatacaaatttggattcgttttgttcgtttccagctcaccctgtaaatcgtttctcaagtcattcaggcatactcacatcgcacaaacatatatataccccaagattttgaatccatcaatttgcagacgccataggcgtacaagttatccattcaagcgctccaaaaatttgccaagaagtttgccttaaatttggattcatgaagtttgccaagaagtacgagaagtacatgaaggggatggatgaggagctcccgggcgtggggctgaagcggctcaagaaattgctcaagaaatgccgctctgacctccaatcccacgagaacgacggctcctccgccggccgctgccccggccattgctctggtgaataaagctactatacctttcaatttcctcctatatggtctctttgatgcgtaggactattcttgattctcttacactgaaaataatgctgttttttcaaaagaaacctgttggtttcttgttttcaatgaaaacgaggattaatgggcgggctcatgccttttggtactttttttttcttttggttaaaaaaggacaaacccttggcaaaatggcatacctagaaaaggattagaatttaggacttgttgcaacttgcaagaggcaattgttttttttttcagtttttttagtttcatcgtgctgagaagtgagaagaactagttgataattctgcgggaacagaggaacctgtaggctgtacacagcggttttggtattcggcaagttgaactcttcctgggaatgccaacctattttctcttatttatcctttagatatatgtatcctaccttgttctcgctgtacttcttttatttatagtgtcaaacaattacagcttcgcatggaagagaagctttactgcagagaaagcaacaatttgacttcttagcacaattctttcgaagcattttctctgtcgccccttgtatggttaagattggattttaaaatggcgataatgttttgtttgctttcaaacatcaataccaacaaattaagttgatcggtcgggtatttggaaaatctgcatatactactgtcgtgtggacggcagatttataacataacttcaaattgaacactactagagatagcccattgactgccccattataatagtgcaagtcattgtcaaggtggtaattgtttgtcaatgacaaccacgtaatttttcaagtgccaagatactataggccgtagtaaccatggaaaaggggatgtcaaccatcacaaagtccactcttaattttgtattcattagcaggggcttattcatctgtccttttgaataactttcgattattttagttagtgtcgacttgtctactataatttgggatggttttgatataaatatttcagagtcctaaaagagtcgattattcctggttctttcatattgatattgtaactactgcggtttgcctagaaaagaatattagagtcgccatgatggttatttttgtctaccttacctttcatggttggttatctgacaaattcctatcaacatgcagtatgtgatgggagttttttcccatctcttctcaatgagatgtcagccgttattggctgcttcaatgaaaaggccaagaagcttctcgagttgcacctggcatcaggtttcaagaaatatacaatgtggttcaccagcaagggtcacaagagccatggggcattgatacagcaaggcaaagacttggttacttatgcaattataaatgccgtggccatgaggaaaattttaaagaaatatgacaaggcatggccttaaactttaatctttgcacctctctttatctcttaaaggcattagaaacatttaaagcttactaaggacaaagggggaatatttttttttggaaaccgaacgaagggggaagataactatataagtattccattatttgagagaggaacacaaaaatttcacacacttttagttataagcatgtgagtttggtgaagcccaaaatgctagtctatataggtgtcaatgggtcatatactcatatggtatcttcgaggatatatatacacacacacacagaggatgattgagttgtatttatatatttaatctttctagtgactatttttgttagaattaacgtatctatcattgttcttgtctttggatttaagacggtcctcaatggttatattaataattatgtaagactattaactaaaagcctctcttttccagatacattactcgaagcaagggcaggaattcaaagctcaagcccagagtctgcatattgaaatacttcaatccccatggctctgtgagctgatggctttctacatgaacttgagaagaagcaagaagaacaacggtgctatggagctctttggggattgttctctcgtattcgatgatgacaaaccaacaatttcatgcaacctctttgactctatgcgtgtcgacattagcttgacatgttcgatttgcttggtgagtttgcacttgtcgactgcaccaagatcttaatttacctaacaaggatatcattaatacactaaattttttatgttatgaagtatgaattcgtacttaggttatattctccttgttataatgtgctcaagtatcaactttgttccttgttactgcgaaattcatagcacttccttattgcattgtaaatttctgaaattcacttgcttttgcaggataccgtgtttgatccagttgctctttcctgtggtcacatatattgctacttgtgcagctgttctgctgcatccgttacgatcgttgatgggctgaagtctgccgagcgcaaatcaaagtgcccactgtgccgacaggtataaacaattccttcaattcgatctttgttttagataacattccttcaaatttgatgaccatatgcttgtgcatgtcccatcaactgacctgatttctcatttcaggcaggagtctttcctaatgctgtacacttggatgagctgaacatgctactaagctataggtaagtctgaactgctcaggatcatatcatcagtcatctgcacggccgtacaaatgtacacttttttttatgtcatgaacatagattatcaccatatttcgtttatcgcaaaaggacaaggattgttaccaagttgaaatttaatatggatcatctattgacagttgtccagagtactgggagaagagaatacagatggagcgggttgaacgtgttcgtctggctaaggaacactgggagtcacagtgcagggcattcttgggcatgtgattctaaagttggtggattttttttttctttagaggggcttcatatgtgatgtatagtttcttgacaaaatggaatttgccatttgttgtcacttatatcctgctctgttgctcctctttgtgtaagaagttggatttgtcatcctaaatgcaaaaacagcaggggttgttcactactgtgcacttagatgtaaatagggtagatttgtagtcattgttcaagtgcataactgtaaattcatttatatttgatcagttcaatctgggggtttgactttgtggttaatgttttgggtccctgttgctgtcatccccttcaacgtgtgcgtggccttcatgttgtgttaaatctagatcattttctgcagtgattaagtcgatgcacgtatattatttcatttcctgtggcgctgaacaatgtggcttctaaaactctccaggaataacaaaacccatcgtatagctaaatgtggataatgtcattcggcgtattaacaaaataataataatttataggtaaaatttttatataaacgttcttagctacttaaatattactgttgaaaaataaacttcaataaaaaattttaaaatcaactttaaaattaagtttgaaaatttaaattttggtatcaactgatgttttatggagtctttcttttactgtaatgttcagaccgcttgttgtatgtggggcttaatatatttaatgtatccctatagttaagtgataatccgtaaaataatccaaagaacaatctaacttaaatgggcccttgaatcttcggcaaaatgccaaagaatgtttaagcaataaagggcagttcttcaatcagctcttaatatgtgatctcctttgttgttggcctcctaagtattgatttagacaacatcaaaccaaatgtactaggtacatgttaactccatttttaaatgtataaaccaatagtcccaggctcccagcaaaaataaaaaaaaatgaccaagaaagatctagtttcatgttaccatgttaaggctctccattcgagattgaatttagagtgcaaagtattgtaggtctgttcggggaagcatttgtttgggagagtttaagattataagaagtaactggttgatagtcaacttacgagaatctgcaaacgctcaacttttagcttttggtttctagttcattttctgaattatacaactacagattcttagaaactggaccaaaggctagaatgtttgaggagattctgattccgagagaagctgctgcagttagaagctctcccaaacag

SEQ ID NO: 814 - DNA, 3815 bp, Oryza sativa
atcacacgcgagtcaaagttgggacttagaacgttggtggcacaagagacgggatcaggagagggggaggctatgttaaaattagattgttacacaaataacaatgtaatctgagctatttaataaactatatataaaacatcaggcaactaatgaatggtcaagccgttatcaattattctggatggtaactccctgccttcgatgcaggacggagtgtagcgggggcccctgtccgaccatcccttgcgataagagtttttttctttctcagtaacttatatttcctgtatttgtgttttttgtttcttttttttccttgacccctagcaacggccctctgaccgtttgcgttgtgtaaccaaactctgttgtcttcttctaatatattgacgtgcaatcatttagcgcgttcgcgagaaaaaaatggtttggatggttaaatcttactagaaaccagaacaagataggctacgcaattagcaatggatggttggcattaggtcatctaaggtcaaaccgacggagatacatttgctgcataaatagcaactagcgtaatatgtgatgtgatgtacttcctacgtcttataataagtttattttttagctacttatatttgtctagaaataagttaatttttagaataattatttgtatcggagtttatgaaagtaaaaagtaattgtatttggagtacataaagtgaggaagtattgagatttgataaagtagaggtattttagtttttttttattggtacgtatgagattagtgaaaaataaatttatttgggaagggatgtagtacctagctactcttgtaccagctagattaagtataaaccaaaaacaacgggagtagtagtagtaagaatgtaaaacggttccaacataacgcaacaacggaacggttggatattcggttgggaggagaagggagattccgtttgagtaggttataaatagcaaggaatacatacgtacgttccaaatcatcacaaagcaagcaattaagctggcatgggcggcggcggcggggagcagcagcagcttgaggtgctccacgccctggacgtggccaagacgcaatggtaccatttcacggccatcgtggtggccggaatggggttcttcaccgacgcctatgacctcttctgcatctccctcgtcaccaagctgctgggccgcatctactaccgcgtcgacgggtccccgtcccccggcacgctccccccgcacgtctccgcctccgtcaacggcgtggccttcgtgggcacgctctcagggcaactcttctttggctggctgggcgacaagctcggccgtaagcgcgtctatggcatcaccctcatgctcatggtgctctgctccctcgcctccgcgctctcctttggccacaccccgacctccgtcatggccaccctctgcttcttccgcttctggctcggcttcggcatcggcggcgactacccgctctccgccaccatcatgtccgagtacgccaacaagaagacgcgtggcgccttcatcgccgccgtcttcgcgatgcagggcttcggcatcatcaccggcggcctcgtcgccatcctcgtctccgcctccttcagggccgccttcccggcgcctccctacggcgaggaccccgtggcctccacgccgccgcaggccgacttcgtgtggaggatcatactcatgctgggcgcgctgccggcggcgctcacctactactggcgcaccaagatgcccgagacggcgcgctacacggcgctcgtggccaacaacgccaagcaggccgcggccgacatgtccaaggtgctgcaggtggtggagatgcgtaatattggtaataatggtggcagcaggaggccgttcgggctgttctccggcgagtttgtccggcggcacgggctgcacctggtgggcacgtcggcgacgtggttgctgctggacattgcgttctacagccagaacctgttccagaaggacatattcagcgcggtggggtggatccccaaggcggcgacgatgagcgcgctggaggagctgttccgcatcgcgcgggcgcagacgctgatcgcgctgtgcgggacggtgcccggctactggttcaccgtcgcgctcatcgacgtggtgggccgtttcaagatccaggccgttggcttcttcatgatgaccctcttcatgctcaccctcgccctgccgtaccaccactggacggcgccggggaagaaccacgtcggcttcctgctgctctacggcctcaccttcttcttcgccaacttcggccccaactccaccaccttcatcgtgccggcggagattttcccggcgcggctgcgggccacgtgccacggcatctcggcggcgtcggggaagctgggcgccatcgtcggatccttcgggttcctgtacctggcgcagagccccgaccggagcaagacggagcacgggtaccctccgggcatcggcgtccgcaactcgctcttcctgctcgccgcctgcaacctgctgggcctgctcttcaccttcctcgtgccggagtccaaggggaagtcgctggaggagatgtccggcgacgccgaggcccaggaggaggcgccgccgcccctgcaaactgtactgtagcgctgtcgccgtctgcatatctatctatatatacatgcagatatatagccaccatataatataactgatcgatcgagaccagagaagatcgatcgaagaaaccgccagttgatatataactggcctggctatccactatatatatatatatatatatatatatattttgtcgttgtcgtcggcgacaccatgtaccttttcttctccttaattagccttattgtgtttcatgatgtgtcgatctacttctagttcgtcgtcaacgatccctgcctttttacaatcttgagcttttgcgcgcttttgacaaccgatcaagcctaactatatatataatctcgtagaaaatagaatatgtcaatgctagctaactgtacatcattatataggaactgtctaattaatgacctgaaaattcacttagtaacatatttttactcccccgtccttatttctagctatgtatctacacatgtgtatagccataaataaggtttttctataaaagtagtattgaattgctaaacaatatattttgtctgtgatagtgatatctcttgtgcatgtaaacaatatatatactatcccacattcatattgatgctaatgaatctagataaatatatatgtctagattattcattagcatcaatatgaatgtgagaaatgctagaatgacttacattgtgaaacggagagagtagccaatattaacatgaaaacgtgtccaatcaaagcacacagtaaatacatgcggtggcacccgaagatatgccactacaagaacaatacgtgccatcaggttctgcaagtactacagtgaaagttccaggagagaacccatcagggcaagtgcgtgtcgatgtgctataggttggctgacagggcctacggcacccttttacatcgcacaaacgaaataccaatatcaatttggggttggaagggttaagggggatatggattataaaaaaaaaaagtactccctccctttcatattagaagactttttagcattgcccacatttatatagatgtttatgaatctagacacatatatagattcattaacatctatatgaatataggcaatgctagaaaatatatgaaactgaggaagtaatggtttggtgttgttctaatgcttccaatatgaaacaaaactttacccagaaattccaggtaga

SEQ ID NO: 815 - DNA, 6043 bp, Oryza sativa
tttcgattttgagaaattatagttaataactacaaaatctagaaaataaatcagaagtcaaaaatccaagtttttcattctctccgtatctttagaaaccggctactaatccatcgttgtttttcagaatcttaagctttccgaagagggtctgtataactaacgaaccatggggttgggggtagggtaggggtggcgtcctgttgtcatcttttatccctcttgaattccgggggtgtacccatcactccctcctttcatccatcatcaagcccaccaccaccaccaatttaaggacactctctctcatataatgcttatatatgatcctaatcataatgataacaatattatcattgggtaaatcatatcaatagtagtagtagtagtatcatcatgttgtacatgtagtatattggtgcagcaccatattgtgttgtagtgtagtgaagctggactggacctatgttttatatggggaccccaagagaaaaagatgcctcgtttcgtttgtcaaactcacctttcctttcctcccgtgatcttctaatgccagccttgctgctgctaatcgccatgctgcccttgtgctgccgccacccccctagctacccctcctctctctattctctctctctctctctcacttatccacttttaactaaatattaatgatatctttacctagataatctaataaaaactactacctccgtccctaaaagaatgcatttctagctacgcatctggatataatcttttcggaacggaggtagtcctacttgacacaaacagagttatatggacacaataattgagccaaaaaacatggtatttattctgcgatatgctactaagtatataattggattattagctgcatatatattcatctgctgtcctgtgagctgcaactgtacaattctgacttgtgcccaagaacgaggggaagagagatgagatgaatgaaacggacctgtgccaattgccaaagcagagaaggtcaggctgtcaccagaaagtcctttttccccggctagctcctgcatgcagctgatgagcgtcctgcatggagaagaaaagaacagatggtgacactgaattccaagagtgagtatcacttttattttaattgatacatactacatacatacagacaccggcgatgtgctaattgctccaaaaatctccagaaaaaacatatagtacaaatgcatatataccacaacagacaatgcaagcctccagaacggatgggatccgtctgcatgaggaatcaaaggacaaggatgatcagctggaaaccagattataaaatcatcaatcaatgccttttgattcgccgcgcgcttgtttaatgtttaatgggggggatgagtatccgctgtcacatgggcacaggaggggggatggatgccattacaatcctaatcatggaatcatggattaaacttttcccccttttcctttcatcaggataccaggccataatacttgcattgactagctcatttgggatgaatactataactccaaatgtttttgtctctgtcctccaggcccttgcatcttttcttttctttttttccagtacttctaaattccaagaaacacaaccggcctctccacaatgatcaatcgatcgaccgatcggtgttcccattgacggcagagacagtcagcagacaaatcattattcctgtacctgcgcaattatctgtgcaattatggggaagctcaccgttctgaagaactgatcaccacagacacgctcaacgtgcttcatctcggattggagaagcagatacggatttccgaatgaaaattgctagggtatctagctgcatgcccatggtaaacaaaggggagaagatgccctctgtcctggaataccaacatctgatgccaccacttctttttccccaggaccccaactgtgatgattgacggggagcttttccacagagacaagtgatccagtgacttacctgaaaagcaagagaaataaaggacaatacttaggtctgacacataaaatcttgcaggtgggagaaaatgaggtgcacatgcacgcacgcacgcacagcacaacacagcacagcagctaacaaaattgggacttaattggcaacagaagaaaggtggacatggcctcccagtcccagcactccagcagtagtctgctgctttctttgcccctgcatgaaacactcgtgatgtacaagtagctgcaggaaagaaaataaaaggagaggaaaaaaggatttaaaagagagaaaatttctgatttctagtagaaaatggtgtactggctgggtcgcagtcaatcaacatgggagcaagaacatcagtccttgtcctaataatgtaaaccctgatggactggttttactttcacttgctgactgattctcatcaaacaagtacactggaaatgggaaacgagataaaaggaaaaaaaaaaaggcgaagaaggaagaagatggaacagttttttgtacaaggccgcgacaattaaaatatcggtggagacggacggcaaccccaccagttttggcaccggacatagattcttaggagatgacgagacagaccccccacacgcacagccaggaagcaaccaaggcaaggggttaaacctcccttctcacaaccaccaccaccaccaccaccacctttaaaagaaggtgctaaagggggtgtcctgcaaagaaaaggagaggagtgccccctaacctttccctgctttccactgaaatctcctatccgcaaccatacagttgctcaattctggtctcagccaaagccccaatcattcatcgttatataggtcactataccctcccttgcatttcccaccaccaccccttgaagccatgaatcgctgaagaagtcgtctgcgctactgctaccaccggggaaggattagctgcgcagaattgtgcgagcgaagcctgccagccgtgcgaatttcaagctccgaggtcctgcattgcactgaaatggggaggcattcttgctgctacaagcagaaattgaggaaggggctctggtcccctgaggaggatgagaagctcatgaatcacataaccaagcatggccatggctgctggagttctgttcctaaacttgcaggtgagctcaaacaagtcttctgcatttcctcgtttataccagcttccgattcttctcttatctcttctccaacaattctactccctgaattggtccaaaattctaaatttcttcctggtgaattgttgcagggctccaaagatgcggcaagagctgcaggctgaggtggataaactatctgaggcctgacctcaagagaggtgcattctctcaggaggaagaagacctcatcattgagctccatgctgtccttgggaacaggtaaacttcaatctcaattggcactaccaaaattcaggactagtaactgcaaggcaacactttgatacatcaactaacacagcccttctatttttccatgagaaggtggtctcagattgcagctcagctgcctgggaggactgacaacgagatcaagaatctctggaattcttgcatcaagaagaagctccggcagaaaggcattgatcccaacacccacaagcccctcaccgaggctgatcgcaggggagcagcacccacagtcagcaccgagaggacctcagggtccagcgacgtcaacccgtcaagtgctggtgctctagggaacttgagccacctcctcagcgagacagcacaatcatcaatgctgctgccggtgtatgataagaatcaccctgaaactgcaagcttgccacgccctaaggtgccaccaaaggagttgtttcttgaccagcttactgccggtcacgagagcccatcaagttgccgctcatcaggtccaaccctgtattttcctttccagcaaccattaggctacagtaatgaatgtggcactggggatggtgcgagtatgaattcactctggttcaaccagaatgatttcaactgcagcacaatctccaccgtgatgccaccagtttcaccatcagccctctcaacatcaatggggctgaatcttcccccagaaaatcctcgtcacggaggcactggcattggcaacaccccgttctactgggatggttccaatcctagcagcagcggcagtactgggagcagcggaagcaacagtatgggattcgagccacagagcacaacctcaattttggagaacagtgtattcccatggacagatatcggacaagagaaagataccagagttcacttagtggaggaactcaagtggcctgatttgctccatggaacctttgctgaggcgacgacagccatgcagaaccagagccaatcattatacgatgatgtgatcaaggcagagagccaattcaacatggaagggatatgtgcctcttggttccagaatcagcaaccacaacaacagctgcaagcagcatcagacatgtatgataaagacttgcaaagattgcccttgtcttttgaacatatctaggtgcaatgctacgccatgcatggaacagagcagagatcagaagaagcagaaacttgtaactctcgcatattgattggcaggcaaaacactgaagtgtttgatgttttgacacagaatcgacctcaacactttctcctcacttaaagatcctacagtgtcatggaaaagacagctctggccttacgagtagcagaagaagggatagaaaagtacgttctagagtctccctcttttctcttgaaatttgctgttttttgtacacgacaactcaacttttggatacttgagttttggttcactctgtttatcaaataaatatagacacgcatgggcaaaacatgtgtcggtagctctcacaaaccatacaagtagtcccaagcttttcaactgctaccatgcacgtacatgcaaattaattattgcatgttgtatttttatttcttttgagaagttgccgacaaagtgcagttgtatatttgtaaaggaaaaaaattggaacattgacccaagagttattttcacctcctctccctttccagtttctgtcttaactttttatgtgaagaatccaaagctacttgatcactttctacttgaatacaagcagggaaaaggattggtcgatttgataggtccaaagaggtaatcatcctccagagaaagtaaacacatttgacaaaagaagaggaggaaattattaatgaatatccacctaccatatggatgggtaatatatgaaacatcaatgtgtggcgggcactcaagatatgcttatctatgtgtgtacatcacttgtttgtgtaccaaaactatggtacattacttatttgtaaaccatggaaaatgtatgtctgccttacaaaggccaggagtttaattgttcagcacctaagagattttgcatgcttctttggtttatcccataatgaatatggacttgcagcacttcttaatctaggtttgagttaagattcattatgaacttgcggcacttcttaatctaggtttgagttaagaaggctaatagacataagagcctagtctcaacatcttcgccctgagggacaatgtgtaaaggaggagctacttgctggctgtgtgaggggatgcctcatccctcgggcgtttgtaaaagggaattattgattgctctaggaataattggaattcagttcataaggatttgggtcaaaatgcccctatccatacagtccctcaagttagtttttgaatatagaaggctcagtagccctcagtgctcaataaagctaagaactcctaaaatgataaacaaacgaggaaaaggaaaggctatgccactattttctttggcctgtcaggtgggctcctttttctctgactactcaaaaattaaatcagcatcatattggtttgtttctatgcatggcagtagtcctaattaaaataaagttgtctaatcaggttcctaggccccaaattagctttagaagttacatattttatttttatgtgacataattaatggagtgtggccatgtg

SEQ ID NO: 816 - DNA, 4078 bp, Oryza sativa; identical to SEQ ID NO: 585

SEQ ID NO: 817 - DNA, 4291 bp, Oryza sativa; identical to SEQ ID NO: 426

SEQ ID NO: 818 - DNA, 7163 bp, Oryza sativa
tgattgtcaactatactagacatgaagagactacactgtgaaaagaacgcacaagaaacaaaacacaaacgaattgtaactctaactctccaagaacaaaatctcgatttgagccacacacgtatttcacatatactagttcggttcttaattattgataaaaagcatgtgatagaaagattttatttgcgaatttataacgtttaggtatatatcatgagtatagtggatgctttgggattgtacaacaagtgtattgagatagctaaaatggtatcctcctatacttgccgagtttttatacgaatgcatagttttataattttttttcttaagatgatatgtgctatagttttcatctcttagataaattaattacatagctaattttacaaaactaaacaaaactgaacggtaaccatcgaccattattttatacccatgtctatgagttaaagaactcttaccacgaatcatcaccatagcaataaaactcattcctacatcaatagtagtagctaccagagttctccttaccgtttttagcgtggttaccgcacccccacagtaagacggttaccgtggtaaccacgcggttaccgcgaaaaccgcgagacataccgtggtttaaaaactaaaaaggttactgcaagtggtaaccgtgtggttttgtaaatcttggtagctacatattccagtttagaaaaacaataatgaaataaacagacagttctttttttttaaaaaaatagataaatttcgatgatgcactactccaaaaggaaagacactttaccatttttattataacaaatcaatgtcgcaaatatcacgtatcaaaacacacaaataattaacaacaacaattagactctaaaaatagttggattattatatccttattattctctaaattcatcaacgaaccaagccaatcttccaaccgggcaaacaaaaataagcagagaaaaccctcatccagcgttgacaacccaacagtcaaaggataacccagcgaatatcccatccatccaacccgtccatccgggcccaccacaacgcgtcatcaatcaacccatccatcccccgcaataatttctctcgcttccgccggtcgccgcctccctccgccgctttcttcccctttaaaaccctcccaaaattcaaacgcgaccaagccgccggcgaggtgaacgaaacccaaccatggcaggcggcggaggtggcgaggggaaggtggcgtgcgcggcgtggatccggcgccgggaggagaaggagaaggcgacgcgcgtcttcgcggcgtacgggcgggcggggtcgccgccggccgtggaggtgctcgggttcgactccaaggagtgctccctctccgaacccctggtacgtacgggagctcccccctctcctcctcctcctcctcctcctcctccgagctcccaaggaattcgaggtttggttcgccggcttgacttccggggtcgtggttgtgtggtttgtttgtttgtgctgcaggcgagggcggagctcggggaggagccgggcgacgcgccgcgtggcatcacggtgcaccccagcggcgacgagctcgtctgcgccacggccaaggggtgcaggtgcgtgcctccactgcttctcttctcgttgactgttctatcatttgcgggaatttctcaggcggggaggggaggggtgatatgattagttaggagttcggtgttctaccggtagattattgagctaatgcctgtgtagtgtcggagatttcggattattagttcgattcagctgatttgagggtggtaatttggttaattgtgatgcgggagctggtttggttgctgctggctgcctggctggattaggtgatttagaaagcagtgtgaatccgtctgtttagacttcagattgtagaggtctgtgttatcaatgtggctaattatgtttagattgtagtgcggaattgactttctgtgttcatttgatcatttgctgttccagtaacgttcaattaggctttacacttcaggttttctatagaagggttggcttggatgttgcaacctaaaataaaaagggccaccgaagttgatctttagtagggttaactacctcaatgaaatgatcattagaatagcacacatgttgacttgttaatcaaattataaatgcacagtatatatatataattccatgccattttgtactttttagttctgattgtgttatcattttatcaaagccttctgtttgcactgttacaacctgctttctcttttttctgttctctttcactaagactagaactttataattaaaccacatgtttgaactgaaggctattcaagctgatttttgaagagttcactgttcgacttatttcaagagacgctccaccacttgaatccgttggaccgcagaagtgtcttgcttttagcactgatggatctaaatttgccattggtggtgaggtatcggattgctatatgttgatattggagttttactgatcagttctctctctctctctctctctctctctctattttctagtttgcttctatttggtgattatgtgtttccatatgctgcatttatacatcgttaagaagtactatatgtgtattatagaagccatgtgattttaggcacaatatccactgttgtaccattctgtcagattattccatccagaattccagatggttcagttttttatggtctggtgttattgcccagtgtatttagtttgataataatgctgctctctagctgaacttgtacaaagtatctttctatggttcttacaatgctttattttatttttaccactataggatgggcatctcagaatatttcattggccgagcatgaatgtgctcttagatgaacccaaggctcataagtccttccgggacatggatatcaggttagggcaagtgcaagcataattattttcctttattatttgcaaaagaatcccaggatattctcatctgttgaacaagtgttgttgtaaatggcgcaatcatgtagccgttatcttgagagagtaaccaagaactttgataacgtagcagtagtgttggtccaaaccttaatgaagcattttggtcttggaagactcttttttagaccgaagcgattctttgaacctttggttttcgtccctgtgctttattgtgaattgacttttgcaatactgctgcttttcctcttgtagcttagattcagaatttttagtttccacatccactgatggttctgcaagaatatggaagatagatgagggggtaccattggtcaatttgactcgatctgcggtatgatgcgataaatttgtgcaagtcatgttctcttgttgagatactgaaagccttaaccatttggtgttctggttttctatgcaggatgagaagattgaatgttgccgcttttctagggatggcatgaaaccattcctgttttgcaccgttgcaaaaggtatactttctattgtggtccagaaatagatttatgcatatcagatgatttttctatatatgtgctttgtcattggaacaggtaacaaagttgtaactgttgtctggaacataagtgactggagtcgaattggatacaagagacttctgggaaaacctatctccacactttcagttagcatggatgggaagtatctggctttgtaagtacatataaatactgttgatcttatcatactgaacaagtatataactccattgcatttctaggaacatttacaatgccaaatttcaagactaacataagctactttctcctagtaacttcactattttgtcctttttgaagagctcaaaaacttgcttgcatttttttgttacattctcacattgacatgtaatatatcaacaacttgaaacaactgtcacataaataataacaaagaattactctagttgacaaggatgttgcgtagctctgaaaaaaatggacgaaaaacattaacattataaattgtaatagtgacagtatcagctggagtaatgtttttttcctaataaatatgcagtgccccaatactagctaacatattctaaactgaattgcttttgatgtatttagtgcaccgacatgtgaatgaattctgtatttcttctttcagggggagccatgatggtgatttctgtgctgtggatgtaaagaagatggatgtttctcactggagcaagaaggtccatcttggttctccggtttcctcaattgaattttgtcctactgaaaggtactggaactctgtaaagatggcatgtttatcacatcttgaatcttatggatttctagtttgttgtacactgctgttgtactgatttctagtaaggtagtagcttagtgttcactggcatgtaggcgccataatgtcagactcatggttgttaaggcgtcgctatggcgtcgctatagcactagggcgtgccgaggggttaaggcgtccctccgccttaagggcttaacgccataacccagagagagagaaagagagaggtgaaggcagcagcaactaccccttttcactgttctctgctccatgtcattgccatcttactcctcagctctggtttccactctcttcctctctctcctgtgccagattcattttgactaagggagcagcgccagatctatccaagggaagagaagcatagctggattcgttctgaatgaggggagaaaggagcacatatagaggagcagagctagcacgaggaaaaagatcaggggagaaaggagcacatatagaagagcagagctagcacgaggaagaagaactggcgcgaggaagaagcgatgcacaggcgtgaggaagaagcgacatcggaggcggcgctgtgagaggagagacgcacctggtgtgggtattagggttgtttccttgaccatgggctggtatgaaggttattgggcttttgtgggctggcctgctaggctaattttctctctccctcttctgatcgctgctaatcacgtagattaaggcgtcgccacgccttagcgcattaccgctatagcgtaaggcgtgggtgggtcgcctcaggtcgccttaccgccttaacaaccatggtcagactatcaaatgccatgcttataagttataaatcaatgcttcatagattgtaattgtctgtgtatgcctgcaggctgcactgcataatgtcttaagtgggatgtgagtctgaatgttcatcttttactaaatttgctttagtttagcctggaaaagattgcaagataacatcttcctcctgctgggtttggtagggatggcccttatgcatttcatttattcatgcaagaaatgtttctcttaaaactaaatgacctgtccttctccaatttccggagcatctctttgtttatgttataacatgatgcctgctgataccgcagggccgtaatctccacatcgcatcaatggggagcagagctgacaaagctgaatgtccctgctgactggaaaggtacatgtctcataaaatgcttcttggctctcctgtggtataatttaccatactaacgaaatctttttgtgttattcttctgcagaatggcaagtctggctcatactcttatctcttttcctagtgtcagccatcctgttctatatgttctacgagcgctccgattccttctggaactttccaatggggcagcatcagccagccaagccatggagtgtcatgaaggagtctcctccagttcctgaggaccagaacccctggtgaattatctttcaagcaatcaagcatttgggtgttgttttatttcataatgaaagggttttttccaagcctaattcatgttgtaccattttacttgttcgccgatctgaccacgtcagtatttatctaggtaaatcagtaaaatgccactgtaattggtggtctgatggtagttatgaaaatgccatcgacttccaatgagactttcagtggcatttttaagtctattgtaccttgcagtgggatttatccacgtgcttatttacccccttctctttggtagtcaataactgaatttatcagtgtgttctacttctgtatatgtgggttgggatgtgagtacaagtacatgtgaactcagctttaattaagccgctggcagttgttaattgcaggatgtttttttagttctgattttgtttcgagtaaaatgtatagcggtccggcttgaatttatgcacgggtacctctagagagagaacacactattagaggttagggatggcaatttcccccgtgcggggacccgccccgtactacgggggcgggtacagtttctgacccacgggtgaggcggggccggggccccgtatttttgcggttagaggccggggggaaaagttcacccgcgggtgacccaacaaaatactgagggataaaaacaaaccttagcctctagctccccatctcatctcggcatctcccctccagccgctccaccgctccagtctgcatcggcagaggcggcgccagggcgcacgccgcacagtgaacttctggatcttgccgtcgccgatcgccctctgcccctctcccctcctctcccctccatctctccggctgtccctctggctctcctttctggctgcgcggtcgagcggcaagggcggcggcggccggtgagggtgcggcgcacaagcgcggcgtccggctgcctgtggcgagtcgcgagcgcgactgcgcgaggggacaagtgtggggccggcgaggggacaacctcacaaccggacaggagacttttgcttgcttggatgtgatgtgttgaaccttgaaggcttgattgcttgaactcatgtgtgtgtgtcgtgtgtttgcttggctggcagcaacagcatagcatagccatgtgaatagttcaatatgtgtttttgctgaactttttatgatgctattcaagtattcatgttatttttgatggtgtgtctattatgtaccatatttttcatttgctaaattgacgattgtcttatacattttgtgctcatttgatggagttgctactcactgcgggccccgatcggattgcggggccccgcaggggctggggccgggggctggtttacacccgcatgtccactcggggccggggccgggtggagagttcgggggtcggggtcggggccgttc

SEQ ID NO: 819 - DNA, 7060 bp, Oryza sativa; identical to SEQ ID NO: 582

SEQ ID NO: 820 - DNA, 8994 bp, Oryza sativa
gggtttctgcccaaatgagcgagcggtaggcggcgagacgctctcggctctccgactccaacccaaccaggatggggaagacgacgtccggttgttttattcggatgggcctcttgcaagaccatgtgggccgtaggctcctactaatgggtctaccatgattgggctgcaactaaattgacaggtcagccattctggcgtgggctgggcccgatccaaggatggcgtagtcacgacaacacagcatctgttgggcccgatccacctatattatttagtttttgttttctaaaattagctcaagttgggcaaatctacaatctacaattttaataaaatagttgtggtcttctatcatttatgtttgggaaatttgaattgtcagccaaaatttaaattttcaaacttaaatttgaagttgattttgatttttttttcatcgaaacttatttttcagcctttacttttagatcattaagaatatgtatgtaaaaatttcattcacaaattatttttcgattgtagatatgccaaacgatgggggctgaaagctgaatctctccatcccaaaaataaataaacacaaaacaacatgtaatacatactgcataaacatatacatattcatagtgatatgatatgtcaaatcctataatttcttcgtcccaaaatgttaacacctagaatatgatttgatgaatatggacaaaacttttgtttatttcgaaatggagggagaaaacctgcgcacaatattacacacatgaatgtcaaatatttatcatttattttcgtttttttagtatgtgttagcggaactcaaacgtagatatgcacatgatgtaatgatgaaaaactatacaaattttactcagataacttttaaaatgtttggaatatgctcataacatttttttccattttccataaattaaacaaagcaaaggaaggtcaatgacaacgtgggattatttcacgaacaccaacaaacaaaaccgagcagacatccattcccttcccactcgtcagaagcatccgccgcctacctgccaacccctagaattccgaaaatgcccctggaccccgactcctcgccggcgccgccgcaccgggactggttcttcccgccggcgccgcccttcctcccgtcctccagagcccgaacgccgagggcccccttcccctccacctcccgctcctccaatccatactccttcccggaccgccggccgcctcctaccccgcgctcccgctcccgctcccccctcccgccgccggagcagcagaagcagcagcagccgcccccgacgacgcctcctcccgccccgcgccgtcgcgacccccggtatgctggcgtccgccgtggcgatgtccgaacgctcaccgccgagaaagcggcggcggcggcggcggttcctacggccgcgcaggtgcacgggagcaagtcagcggcgtcggcgaccaccctccgatggtcagggatggtatccgtggcggtaagaaatgggtgagctcgcggggttttcgcgtttgacttttgttgactgacggtttaaccgcgtaaacctgatgcttgcaggctattgtgctctgcttctcttcccttgtccgcagtaactcctcgctacatgatcaggtccaccatttgaaggtaaaattccaactgattccaatgcacattctgcataactgcgcacttatacgcggattctatcaggctcagcttgcggaagctactacaaaattgcagtcttgtattacagagtcctcgatggatatgagtagcatattatcatatcagagcaataacagtacttcgcagaacagaggtcttaagaatttctcattgctgctctcgctttctacgctgtacgccccattactcattcttaagtacatggaccttttcttaaagctgaggagttcgcaagactccgaagaagaagttcccataaacaagcggttggcataccgagttgatatatttttatcacttcaaccatatgctaaacccttggttctacttgttgctacattgttacttattggtcttggtggcctggctctttatggtgtaaatgatgatagccttttagattgcctctggctgtcctggacctttgttgctgattcgggcaaccatgcaaacgcagaaggctttggaccaaagttagtttcagtttcaattagtatcggtgggatgctggtttttgccatgatgcttgggcttgtaacagattcgatctctgagaagtttgattcactgaggaaaggaagaagtgaggtcatagagcaaagccacacgctggtccttgggtggagtgacaaactggtaatcctgcattcaatcctgctaatctttatcgcaaaattccatatttctacctacctgtcctgttatgttccttgttgtttgggaatgatgttataccaatagctattaaatatagctctaactagggacgtcattgcaactgttacattgctttttattgcatagcagtctcgctacaaaagtaaagtagttagtgaattctggtatttagtttaaatatgcaaatttcttatatatctgtttctgcagatcaactgatctgagcacaagctgttcctctccagattactgtagtctaagtgtctaacctatttccttttgtggcaacagggatcattgctgaaccaaattgctattgctaatgaaagtttgggaggaggaaccattgtagtgatggctgagaaagacaaagaggaaatggaagcagacattgctaaaatggagtttgacttgaaaggaacagctataatttgtagaagtggaagccctctgattctagctgacttgaaaaaggtaaacattgtgatgtagtgattctgctaacccgcattatgatctgttggcacttggcagtaatcaatagacaattggatggttgttatgttaatttaatgactcactattactttactaaatctatatgcaactctttgttgaactgaatctgccttcatgtacaaggtctcagtttctaaagcgcgtgcaattgtggttttagctgaagaaggaaatgctgaccaggtacattgtgctagttaatttgtattattatacatgacgctttagcttacaccattgcctcttttctagagtgacgcacgcgcattgcgaacagtcttgagtttaactggggtcaaagaagggctaagaggtcacatagttgttgagcttagcgaccttgacaatgaggttctagtcaaacttgttggtggagaccttgtggaaactgttgttgcacatgatgtgataggtcgtttgatgatacaatgtgcacgtcagccaggccttgctcaggtttctttctaatcaacagtaatttctgaacaaagttattttttgatgacacaagttctttctggataatagatacttcttcaagggaaactcatactgaacatcctgatttgattccacttattgtctgtattatggaatctcatgtcatgtgcatccagaaaacctattttagtacaaagtctgattactttttgaaactttttacacacttgtatttttcgcttgattgtggatgtaaatatgctactatgttgaccacttgacccaatttaaatcactttatagttatgctcttgtttgcactgccactaattgacttagtattttatctacttctgtggttctttttagcctggcacggcataattcttaagaaactagcctatcttcttgttctacatgcgcaataattcactcttaaatatttcctgcatgtacataatgcttactataattacctggctgtttgagtattgcatatagtctactacatgcacagccttcctatttactaatttaatgtgtccctttaaatactaatggagttgcataaacagatatgggaagatatccttggcttcgaaaactgtgagttctatattaaaagatggcctcagttggatggtatgcaatttgaagatgtgctcattagctttcctgatgccattccatgtggcataaaggtggcatcttatggtggcaagattattttaaatccggatgacttttatgtcttgcaagagggtgatgaggtgctagtaattgcagaagatgatgacacatatgccccagcgccattacccaaggtaaccattaatctgtaagaacaaaattatctgaaactttctgttctttttatatcatctatcaggacttttttttgtatcccttctggctctgtaacattaatattgaattactgttgttagtcatgccatgtttacatatttaactattttctgtacagctccttagatatcttattatcggtgcctgtcagcctgtgcattgctagtctacttgttgcatttcatgaagtatactcatcttggttgacgttgtttttaagctcattgctatttcctctcatttaccatttggcatcttttattgatatatttatctgaatcactagccatatcctatttacaacttactgcatcaacctaattgcttcaaaactctgtagtatttcacacgagttcttccaatggtgtcttatgcgaattcttctccttgtaatattgttaggctcttgagatccataagtgcagacaaccgcatggttgtcaatagaattttagcttctgcccaactggaactagattgcttttgcacaattcaaaagtaatttctcctgctttgctcattaagcaccggaaaagacaactgcatgagtcaatttatgccttatagatggcaattactccctccattccagaatataacaacttttagctatgaatctggactagtgcatgtccagatttgtagctaaaagttgctatattttgggatggtggtagtattagcctttgttgttacttgctaaaagcctaaaactacaaaagctagctaacttactaggaaagttctaacatagatactgcacatatatagagcatcctgtaacgaagcttacaaaagcgaagtcaattttattattcaggttaaagaagctgtttacatagacattgttcaccccgaaagaaatcctcagaagattcttctttgtggatggcgacgggatatagatgatatgattgtggtaagcctttcgttgaagctcctaatattcctttttctgtaaaactctgcaggttatgagaggttacctacctaaagattttgttgttcccaagtctcctgaaagaatattgttttgtggttggcggcgtgatatggaagatatgataatggtaacttgatgatagatcgaaaacaacattttgtgtcctctattggaatataatattcctattgctatggtagtactaaaggttttggagccaaaatttgcctgtgtcaaaactatgaaaagatataatatcccttcctgttctgagctttacttatttctaattactgccacggcagcatggttgatggaacaagccaatgtgccattaagtgcttagtgttttggaaaacagacctgatatttcttatttttgccctgtgttttatctttctcagtgtttttatcccactgtggtgctgtccaatttttgtagtgactagtgagtttgtactggcatttggccttttgtttcttcacatgatcagatccatggttagctctaatatcatgagcaactatagtgtgttttgcatgatttccccatgagttaatactgtagtttgatacatatgttgaaatggttgcattaacttaaacatctataatcatatgctgtgcttggcttctccaattgtcatacatttctttttatatttttgcatttagtataataaaaaatatattcaaacccttttgtactgaatgtccatcaaaaaatgcaggcctgtccatttgaaaatgtaagtactatgagaattttgtttatatatgctcattttttttcttaaaaaaaagagttatgtttatatagcaacatatgattaccaaatgatgtacgttgcagtgcatgattttttgttttgatgaatggataatgcatttaattacgatctagagcaacagtgtgacttggttttaggtattcaggtactcgatgcttttctagcgccagggtcagagttgtggatgttcaatgacgttcctgagatggacagagaaagaaagctgatagacggaggcctggacttcagtcgtctagaaaatattactttggttcaccgtgaaggaaatgctgttattcgccgtcacttggagagcctccctttagaatcatttgattctgtaagttctgagaacatagactgtagttcctttaggaaaaaagcagtactgttgaaccttcctatgagtacaattgcttgcttctttcctccggctgatgcttatatgcaacacacagatactgattctggcagatgaatctgttgaggattcagcaatccaagctgattcaaggtcgcttgcaacactactgctgatcagggatatccaggttctctctagccatggggaactaatttaaactgttgttcaattttggattttacttaggattgctttagatcatatctctgatcacatgcagttgtcttcgatcatgtactatttttcatttctcaagcctacattagaatattttgcatttaaacaaagatagttggctcacacctttaactactgcaggcaaagcgacttccattcagggaggcgatggtttcacatgttactcgaggaagcttctgtgaaggttcttggattggggagatgcaacaagcatctgataaatctgtcataatcagtgagattctggatcctaggacaaaaaatttattgtcagtgtcaaaaatcagtgactatgttctatcaaatgaactagtgagcatggcattggcaatggttgctgaagatagacaaataaatgatgtcttggaggagctatttgcggagcaggtatgattctcagagctgatggctccatcgtctattgtatgaactagagttgctcctaaaaaggctataacaatctgatcacatgtttcctcacaaacatatatgcaaatgatgttgaagttgtcatcatttaataatattttatcggagcatctgattttaaaataaatactaggggtctgaacctggcactacgatagggaattccattgactttacctgttggctatagagacgttatcgtgcaaagatgttgtgttgggttttctctcgtccaaatgtctgttgtcagacatgttctctggtttctggctgaccaatgtccaagttggcatctgaactttccttgcaggggaacgagatgcaaatacgaccagctgatctctaccttcgagaagatgaggagttaaatttctttgaggtcatgctacgtggtaggcagagaaaagagattgtcattggctaccgtcttgtggatgctgaacgcgccataatcaatccaccagacaaagtttcaaggcggagatggtcggccaaagatgtttttgttgtaattaccgagaaagaatgagttacatcatttagcaaaccatgagaaatcaccactagtaaggcaaaattgacagcagtgcacgtaagagatcaacacgagcagacgactgttgcattgcagaattgacatccggaagaaggccaagcactaactgcgtcagcgcgagagagcaatgcataaccagattttgggatcaatctcgggctatgacttgccaattgcaatgtacataagtgcggaatgatccatgccattgcgcagaaaggatgagaagagaaacaccaagcacgatttgcttagatcagttttgtttttttagagaggggcttcgatcctgtttattgtatagtattacatcttttttgtgtactctgttagaaacttccaaatactccgttggctccgattgctgtacacgcgaacaacaaattcgtatcttacactaatgtatgacaaaagatggcaaagtaacctggtacaattggtcatactgctgacattgaaattttatatggtacaaaatgtgcgcgccatgcaccgagctatataaactatgctactctctgtttcgggtcataagacattttgactttagtcaaagtcaaactgtttcaagaactgttttaagtttaacttagtttatagacaaatatagtaatatttataatactaaattagttttatcaaatcaataatttaatatattttcataataaatttgtcttgggttgaaaatgttactacttttttctacaaacttgatcaaacttaaagtggtttgactttgaccaaagtcaaaacatcttataacctgaaacgaagggagtactatattggaaaggctaatcggcgaacgtttgtgagcttgtcgtgctgggaaaggccgaatctgagtggtggcctgcttgaccgaattatatgggtgttttgtttttttaagaaaattgcacagttgcttgtatgggtatgtttggtacagctccaactcctaaatataactctaggagttgggtctaactctagtatattttgtgagagagctccacccaactccactcccaattttggtggagttgaaactgtttggttgagcttcagcttcaggaggggtggagctggagctggagttgtgccaaacaggccctatatgtcatctagtttttgaatttttaaaatgtagttttaggcatccgaacttattaaactgtgtctttcaattataaattgccacaacatggcatagcacaaaaacattgaaaaatgctatgcgtacgatttgaacttacgatcgtggtacgatctaacgcggatgacaagaattcatggcactgggttaacggctgcataccagcatctacgctaataaacacaagttgtttcatcgtacaaatattgtaaacggcaaatcgtatgtatagcatcactccataaacattcggaacccaaattttctttttatttttgttccttctcctctacttttttttctcttttttc

SEQ ID NO: 821 - DNA, 6047 bp, Oryza sativa; identical to SEQ ID NO: 395

SEQ ID NO: 822 - DNA, 8370 bp, Oryza sativa; identical to SEQ ID NO: 335

SEQ ID NO: 823 - DNA, 7916 bp, Oryza sativa
gtagcactcccacggttcccgaattccgaatataagcatttcttcccagatatcatttcttgaattcaaatttaatatatacaatatatgtatctctaggatacttattccatgcatggaatctaagatttttcacccaattcctaagcaaatcaaaatttaaccaataagtgactttgtttagaacaaccaataagtgactgtggatgtggatatttcctcataaccttcatatttaggaacgaaaaaaagttaaatattaaaaggttgaaagaaaatagattttgcaaagtgttataagaaacttatgtatagaaagctttcttcaatgaatcacatcgtttagtagcttaaaaaacgtacccacaaatccaagtatctaagtagctgaaaataaaaggtcttaaatgtttttagcataaatataaggttgagtgattccttaagatgaagaaataagatataaagaaatgcttttagtgtggtacaattacaaatttcagtctaaaacacatatagtggagttatatatattttcaaacggacggagggagctactagtagtactactatacagccagtcaaccagacacgataacacctccaccgctgccgccacaatacaataatcgtacgaccgagtacggtgccgtgcacatctctctaccttaacttatcccgtatctttatttatactactgtacttcactccgctccagtattgtagccgccgttgccggaaggatgctcatctcagccggcccgttcgtacatccgtacttagcttactcctcctgcgtcattaatccgtcccaaaatatatggcgatttctactttgtcaactctctgctcagctcagcaacacagtaccttacgtcccaattaatagcacaatgtgtttaattaacgatctactagcagatgaaatatcaaagcaagattaattgaagtcaacttctcagcatgcatctctctcattgtcagtaagtagcacttagcacttaattagcagcagcagcagcggcggcatgaattcgcttgcctgcctcatggcgtcaccgaaagatcaccagttgccccagctcccaagccctatgcccctatataatgggaagcacaccaacaccaccaaagctcaagcaagcagcgcgcctgagtacgtagcaaaatccagtgtggtgtacgaacgaaaatggcgacgccgcggacactggtgcccattctgccgcccgtcgcggcgctcctcctcctcctcgtcgccgcctcctccatccccatcctcgccgccgcgcagccggcggacgcgtgcggcggcgcaccggatcaggcggcggcggacggcgcgtgccacgacgtgccgagggcgctgcggctgaagctgatcgccatcccgaccatcctcgtgtcgagcgtcgtcggcgtgtgcctgccgctcctctcccgctccgtgccggcgctccgccccgacggcggcctcttcgccgtcgtcaaggcgttcgcgtcgggcgtcatcctcgccacgggctacatgcacgtgctcccggacgccttcaacaacctcacctcgccgtgcctgcccaggaagccgtggtcggagttcccgttcgcggcgttcgtcgccatgctcgccgccgtgtccacgctcatggccgactcgctcatgctcacctactacaaccgcagcaagccccggccgtctagcggcggcgacgtcgccgccgtcgccgaccacggcgagagccccgaccagggccaccggcacggacacggacacggccatgggcatggcatggcggtggccaagcccgacgacgtcgaggccactcaggtgcagctgcgccggaaccgcgtcgtcgttcaggtaacgtgtctcatgcgttgcagctcactagcaaagctgtaacctcacatcacacacccaactgcgtaattaattaaggctgcgttctaacctcaaggttcccaacctttctctctcgttttccgcgcgcacgcttttcaaactgctaaacggtacgtttttttttaaaaagtttctttacaaaagttgcttaaaaaaattaaattaatccatttttttaaaaaatagctaatacttaattaatcgcacgctaatagactgctccgtttttcgtgcggaagggttgggtcccaacccattctatcacacgcagccttaagaacgcagttgaatatggcaattccaactttttaaccactagttattcttaaataattattgaactaccataaacgaaatcatgtttaaatttacggtgcaatatgctgtgatagcatggtccataatctttttagtatttgcaaaaaagaaattaaaaaaacagacgacaaaatgaatagtgcccacttattaaaaaacaggagtaatcgagtgataattaattgagtttgtttgatctctactacttccagtctataattcttacattttggacattggcacattctttaaaatatatctttgattacattttttctattataatatatgtaataaataaacatatttttatcttttttcttataataccttgtaagacaaatctatacatgttgttttaatgtctttaaactaaatattttaaagttaatgataatcaaagtgataaaagtttaatcttaacgtacactaaaaatcaccctcaatgtgtaatatcctcttaggtcataaggtgggtccagtcattagataaaattgttgctacaatgtatatggaagaggaggcattagctaggtcccactcaatcaaaatccatgttggggggagagggaagaggagagagaaattatactccctccgtctctaaatatttgacgtcgttgacttttttaaacatgtttgaccgtttgtcttattccaaaaatttaagtaattattaattcttttccaaccatttgattcattcttaaatatactactactactacttctcaagtttttgaataatattcacgaaagttttttaataagacgaacggttaaacatgtttaaaaaagtcaacggcgttaaatactccctccgtactcgtaaaggaagtcgtttaggacagcgacacggtctccaaaacacaaatttgacttcttatttctataaaaatatttattaaaaagtgatatatgtatacttttataaaagtatttttcaagaccaatctattcatataatttttacattttcaaacgggagaatagctaatatagtccctcaagtttcatcgaaggctcaatttagtccttcacgttttattttgtccacatagtatttgttttggcttgaaatcatccttgggcccacttaatatgccatatggctatttctagtcaatatttctattagaaaatgtcccttttgcccttaatttgtatacaactataactagaaaagagaaaaccaagatgaataaaataaattgcagatgtactttcggcctattattttaacatgtgcacatgaaacttaagcaattgctattgtatacactttgctagtatataatttatttttattttatacaatttactatgcattatctataaaaaaaatcaagcatgcaattttttctcttatatatgtgaatgatgggggggtataagtgtcatttatgaagagagttgttagttcaaggataagtttgaactaaaatgaaaacttgaaggactaatatggatagattgaaacatcaaggactaaactgagcctcagatgaaacttggaggaccactttaactatttacccttttcaaactcaataacttaaaagttatttatgatttatattcccaaggtttgacttaaacattatcataaacgactttctttacgagtacggaggaagtatctagggacggagggagtatattgttttttttttatatgggtagctcaacatctcgacataaagaccacttgtcttgtagtatatcgtacctcctcagtcaagttaggtaaatcaagaattccaaagcaagagggatctatagtcgttagcctaatctcaaggacgcttccgtacggttcgtaaagaaaatcttcgagatagtaggttagtagtcatgttcagtgaactcatagagtcgagttaattgacaaactagaaggtgcccgtagctttaaattatgtggaacctgcaggagataaccactccatattgactcgatgttttttattcatgaaaatgacacgagcggactagcttgtcatgaaaagtttcaacaacagtcacttttgtagtttcactgtactgtaacatgttacggctggccatcaagatgaattagtcatcggaacttcttaattagttcgagaaaatattgtaatgttgaaagggaacaaattacgttaggttttgctcttaggctgagtttgaaaagagaggtagggagattaagctttttcttgaataaaagatgaaagtcgttagcatacaattaattaattaagtattagctattgtgaacttggaaaatatttttatttttatttgattttaaaataagtttctatataaaagtttttttagaaaaatatagtacaatttaataatttaggaaacatgctatcgttaaagatggagtagctcacttcaactgttcagttgttcagaactcaggcttagatattactccctccatcccaaattgatcattatagtatatgtttatacaccaagactaaggataatttgaatcgcattaatcaagacaccatgcacacattatctcacaatgcatgcatcgattaaaacaccatgccaattatacccttagcatacacacattctcccttgctacattaattgtattccgataaaatccgtatccgtacggttatatgatgatcaatttgagaaattttagattttgttgtatgatgatcaatttggaacggatggagtactacttatctatgatacgccattgtaattcatgcccatttaaaaaataaatttaataaataggttaaacaagtggtataaatcatgtctcagaatttattttaagaaagcatattttaaagtgtagaacaaataatcatctagctggctttcgggctttggtgagtcgtccgagatcctttcgatgagatatctatatgatccgttcaggaaaatgaatatctccagaaaatatttttagttccgtatggcttttttttctcttcactcgaaccaatccacctagattttaataatacgatgaataatctgaaaagaatatgacctcaatcacaaaatattaaattgaggtcctgtaattttccatgtatttcagtagaaagtattcaaactaactgggagatgtttttaatacaaatcatctttcatatcctacacaaaatatttctatgctaagcaatttctctctcatataacacataaaaataacttttaaaatatataaataacaaaacaaaacttgaagcttatataaaaacgttcatgttgtgtaagaacaaaacatacaaaaatccatattaaacttttaatgaaataaatcaattattaaccttgtaattttgggtatttttaaaacaagacctaaactaataatataatgtagagcaatcgatgaactcgtcggtatattataaaaagaagcaatatcaatgataaatcgttaaactaggacatatatagtagattatctcttggaataaaagattgagaatcatacgaaatttgtttggaacaatatattcaatgagattttggagaaaagttaatatgaggttgaatctctccgaagattttcttggactcactcactcactctcattcaattcttgtatttttctgtagcctatccaaattattattactgtatttttttagtgtgtgttttgcataagtatcctaccaaaatcttgtacgtttccttttatatgctttaaaactcctatatttcaaaggaagacatattgttggcaaatagcaagcggacataaaccagatatcttcttttctcctttaaattatatgtagtttcacaagcaaaataagtgatgttttatacttaatttacagccagcttcttgtcgagtactagttgtaaagtactctcgattaagataactttgaggctaattagtcattagatttttttgaaacaatatggtcggtcaaactacaactatgcaacttaaaagcgaaaaaccaaaaaatatactgaccagatttgcacggcttcatatgctgcaggtcctcgagataggcatcgtggtgcactcggtggtgatcggcctcggcatgggggcgtcgcagaacgtgtgcaccatccggccgctggtggcggcgatgtgcttccaccagatgttcgaggggatgggcctcggcggctgcatcctgcaggcggagtacggccgccggatgaggtcggtgctcgtcttcttcttctccaccacgacgccgttcggcatcgccctcggcctcgccctgaccagggtgtacagggacaacagcccgacggcgctcatcgtcgtcggcctcctcaacgccgcctccgcggggctgctccactacatggcgctggtggagctcctcgccgccgacttcatggggcccaagctgcagggcaacgtccgcctccagctcgccgccttcctcgccgtcctcctcggcgccggcggcatgtccgtcatggccaagtgggcgtgagctgacgatgcatcacactctgcggcatcatgcaattcgctgcattgttagattgagcttggtcagactcgatcatcagctgcagacatgttgtacagtgactgtgacttctccatgttgtactgtaattcaggttttcagtgttgtagcgtggttgttcaggttttgttcttcgtgactgatgatgtacttcaatacgagcatctacatattttcatgattattacattatcaagccaaagaactatggtaagatggcaaatttcacacaatatgacaatgtcaacaggaatggatgaaaatatggaatcatgaaaaatttcacacaacctatcatgctcagtaaaaaaaagtataagcagtcttccctagaagaaagaaagatggtatgctgcaatttaaaatcacaaaacaaggagccaggattacctcaagtatttgagccgaaccagcaccagacacaatttatgtccactagcaaccaagaaatacaacttcccatcaatgcttagatcatagtacagtactcgccttccatcaaccatagaagccacccttctcgagaaagaaatttcaccattttcactacattcattcacatctccatcattccatgaccatttccagtttccttgattccttctaaaaattctatgtccatgcccagaaaacaaatcccatgtgaaatatcagattcatcgccactgccactatcattcccatcattgtttacactttcagaatcctcagtatctgatccagaatattcctgtcctttaaccagaagaataaatcagagatgatatgcaacgcacaatattttcaaataatgtaatgtcacgacatcagtcaatgtgcttctgatgtgccagagatattaatatcaaggcaaaattaatatgaaaaaaatgtatattgctttgagccgatatacaagtatttttttattaacaactatgcacccggaattatttacaatgtgaacgcattgttgaacaactttcaccaagtctgggggcgggaaacggtggggatatcaacaatctgaataaagaacgatcaaggaaatgctatgaagataacccaagttaaaaagaacgctacccattatcaatcgcagtatttatatcagtacctctggtgatgtcgcaagttttggtgatgaaacaaaaaatatatcatttctaacatacctgaattacttaaagaccatgagtatctagagctacagcatacat

SEQ ID NO: 824 - DNA, 3420 bp, Oryza sativa
ctggcggttgggcttaagacgactgacagcgaaaataaattatcgctggtggccaaaaaccgctagcgaagatagtgattttcattggtttttgttttttggcggctcaaaattctgtcagcgaaaatccaaaatggccgctatgaaagatggttttcgtagcagtggttatactacacactgtaaggcgtgtataaatctgtgaaaggataaaattggcaataaattagatgtcactagagtaaattagtaggtccaatcaaccttaatctaataacgttagcacatatggcccgccctaaacttttgtttgtgtcaaatcgaaggccatgccagttcaggtagacgattcatcgtccgccatggacacttaggccgtgtttacttctttggctaattatttttaaagtataccgacacacatttgaaatattaaacgtagactaataacaaaacaaattatagattccgcctgtaaattacgagacgaatttatcaagcctaattaatctgtcattagcaattgtttaccctagcatcacattgtcaagtcatggtgcaattatgcttataaaattcgtctcgtaatttacatataaattgtgcaattattttttttcgtccacatttaatactctatacatgtgtctaaatatttgatacgatattttttgtcaataatttttgggatctaaatacacccagatctatggatagttgcaagttgggcaatttgtcatttattttatcaatatacacgcgatcttcaggaaggcaaagtggtgcccaccggccaccgtccacttcagcaccatccgggagtgaccatacgcgagaagcatgaaatcggccttgccaagcgctacggaagcgtgaagcgcgccttattagcacgcgccgcttgcagcctcctctgtccagggctccaggtgttctaccggacgcagaatgcatccaacctaagctacccaacacacctgacgacttgctataagtatcccctttacagccactccatagctcatcaagcagttcgaacactccatttggttgtcattttcaactataatccaccacaactcgtgcaacatcagctcactcgtgttcccaaccgcgacaaagcttcacagatggaggctcagaaccaagaggtcgctgccctggtcgagaagatcgccggcctccacgccgccatctccaagctgccgtcgctgagcccatccgccgaggtggacgcgctcttcaccgacctcgtcacggcgtgcgtcccggcgagccccgtcgacgtggccaagctcggcccggaggcgcaggcgatgcgggaggagctcatccgcctctgctccgccgccgagggccacctcgaggcgcactacgccgacatgctcgccgccttcgacaacccgctcgaccacctcgcccgcttcccgtactacggcaactacgtcaacctgagcaagctggagtacgacctcctcgtccgctacgtccccggcattgcccccacccgcgtcgccttcgtcgggtcgggcccgctgccgttcagctccctcgtgctcgccgcgcaccacctgccggacgcggtgttcgacaactacgaccggtgcggcgcggccaacgagcgggcgaggaggctgttccgcggcgccgacgagggcctcggcgcgcgcatggcgttccacaccgccgacgtggcgaccctgacgggggagctcggcgcgtacgacgtcgtgttcctggcggcgctcgtgggcatggcggccgaggagaaggccggggtgatcgcgcacctgggcgcgcacatggcggacggcgcggcgctcgtcgtgcggagcgcgcacggggcgcgcgggttcctgtacccgatcgtcgatcccgaggacgtcaggcgtggcgggttcgacgttctggcggtgtgccacccggaggacgaggtgatcaactccgtcatcgtcgcccgcaaggtcggtgccgccgccgccgccgccgcggcgcgcagagacgagctcgcggactcgcgcggcgtggttctgccggtggtcgggccgccgtccacgtgctgcaaggtggaggcgagcgcggttgagaaggcagaagagtttgccgccaacaaggagctgtccgtctaacagccggacgatcgaaaggcgcactatattatggcaataaatcatttgattatacttatgctgcatttgcgaagctaaggtatactatgcaagccatatgtttgtgttcgtacgtgttgtttgggacgtacagttgtgttgttgtacgtcgtgaagtactgaagtgttcacagtagatcacaagttcacagcaatcaatgaggaccctgtaagccagtgtaaacgaggaacatgccatctgtgtatgacagtgagaaattatataagaaaaacattttgtgacaaaagtaatcagggctacctttttaaagtgctgttctggcagcccttcgctttttctttggatttttagagtgttcatttatcttgtgctgaaaataaatggtgtagcaaaaggtacagatttaaaataggaaaaataatatattttactccctcaaactatttcaccggagcacttagcctcctaaattattttttttggctcattttacatcccgaactactgaaaacgatataccttatcccttacattgtttctctttgtgtaagtcaaattttccactaacgtttttgtaggatgatatatgaattacaactatcgtctcaacatttttataatttttttctcactgtttacataggatgaaaacacctaaaactaattttatcatcaacattttaaagttcaattaaatagtaatgaaaaaaattgatttttttttgaacttagataatggcgtcatctatgattgtaaaaattttcagcttagaatacaacttgtataaagcgtaacataaataaaaatattactattaggtaataaagtaaactattttcaatagtttaggtttaaaatgaggaaaaaaaatagtttaagggttaagtaatcccatgaattagttcgggggagtaaggtggattttctttttatttaaaagtctgacgccaacgatgtcgagtggcgctgagacgacgcggcgctgcagattgccttggtgacacgttatttagctaaccagtgcatgcaatgttgtatagtaaattctctaaaaatatttatatgtcagaagtatgcaaaaagttcccacatattaatgacaaaaggggattatatctttgagctcctttagagcacaagattaaaaaaaactaggaatatgatagagattggtgtgtaaatcagaggattaaaatacagagaaattttatcgaatagaagtatgtgtttggatagagcataggaaaaacatagaattctttgtaagctttcgggcaaaggaaaccgaa

SEQ ID NO: 825 - DNA, 5647 bp, Oryza sativa; identical to SEQ ID NO: 225

SEQ ID NO: 826 - DNA, 2612 bp, Oryza sativa; identical to SEQ ID NO: 533

SEQ ID NO: 827 - DNA, 5354 bp, Oryza sativa
tttaatattcagcataaatatcgtcgattggttcatcgggcatctacttcattatattataatcggctgattggattgtttgttaaagttctatcattgtttatacaagtgttagaatctatatcggacatatagtcgattgttcaaaattctatggacattggctagtatcgatatcagctaatatcgctacatttgcttgttagccgatcggcttttcgatcatttacatatttatatgtcttgttagtcgcaggatcaaactgactagcacgcccgtatctcatcaataatttagaacctgcactagcgttttttttcggagacctgcactagagttaagcagatctcccaaacaattgtgttgtttttcgcgtcaatggaggtgagtgttacatcgataatggtgcgcttgcgaattttagatgtgaccgtatcacaacgacgactatgtagttttttttttttgttagttctcaactttatctttctctttttcacacgcatgttttctcaactactaaatgatatgtattttacaaaagtattagtaagaaagttactttagaaaattatattaaccaaaattttaagttattttaattaatacttaattagttatgtattaatctatcgttttccatgttgcatacgaaggggaggaggagttgagaataagtcacatcaacagtaaataaagtcaaactcgcgacaggcgtggccgacctcaaccacacccgaccgtccactgaaccgggacatcctcacggctctccccaatcccctatcccccaaacccgtccagatccatcgtgccagctactatagctcccaaacaccggtcgtaactcgtaaccccgtacggagcgtgtcggtgtccggtgtccccccgtatctccgtgcccccccaccacccacccacccacccccgtcacgtgccggccatcccaaccaaaaccagctcgttttccgcgagaacccacgcccccctcggtctcccctccgtctgcagggagccagacacacggggtcgcggccctcacgtgcctcgcgccgtgcggcccccatcgccgtcctcatcctgatcctaatcccaagcgaccgcggcgcgatcacgcggcgaccaaccatttctctcgtcgacgagacgacgtgcccgccgctcgccaccccccccacccgctcgcgcggcataaatacagcacgccacgcccatccctctccctctcaccaacaacagtaacccaaccagagagcttgcggaagcgggggtttggtgcgggcgcgcgcgtgtgaggggggagagaaggccaggaggaggcgacgccgtcgcccgagggaggcaaaaatccgatcctcctcctgccctgctcgctcgctcgctcgcctgcgctgcgcgcacttggccccgtcccgtccgttcccgctcgccaggtgatttcttgcagccatttttccccgagattacatggtttgtggggttagttgggtgggtggtgatgccattgttgcgtcgaatggcccgctggggttggatttgaggtcgcaatcctcgtcggtgtgccccgaatagagtgattcttgtctgcttcgggggatctcgatttggggattaggagaagctttacaatcttctcgatagtatacaagattttctttctgatttatctgctgtttttgcgctcaaaatgtgcaggcatagaaagatggtgctctgggtcttcggctatggctccctgatctggaaccccggattcgacttcgatgagaagatcctgggcttcgtcaagggctacaaacgcaccttcaatcttggtacgatagatttactcctggttgtcttggaaaatgggcttggaaatgcagaatcagtagcttaaacttgccgctgttctatattggcctcaacttttatgtgtgcatcttcatatttttcttcctccctgcagcttgcattgaccatcggggcacgccggagcatcctgcgaggacctgcacacttgagtccgacgaggaagccatatgcgtaagcgagctgtcatcttcgttttcccatttcaccgatgcaccgcattgaaatttttgcactgaattgaagcatacttcacttattgtgctatatataaatacaactatcttgacgattcttccgtaggatttgcatcggtgacattaccgatactctgttgaaccttgtagatgcttttgttttaggaaatagccatacaaaatggtaagttttgatgacaattaaaataaccttcttaaaggtgtcaatgattttggagaaataactgctacatgagggattttttttaattgaatacttcagttttaaatagtctcttgtgcaggactggagagaaaagttgcttctgtgccttgcttgatttgttatttgggagaggaatacaacagtaactaactctataacatcattagaaaaagaacacaataaccctgtagcctccctcatcataggggcatactgaccttcactgttcgaatttccaataacctatagtttttttgactaaaaaaacgactctgcaataacctctagtaacttactcacattggtatggtggatcggcagtctgcagattagcttaatgcaaagcatgactgaccaactcatgcacctgatatttacagtttgacatatcatgctgagcagtggcaccaaagcacaatcctattagggactcaaaagctcatgtaaagcagatgactactggaaatctggaatcagatggcagatgactgagcaggaatctgccggtggattctcctcacaaaccatgctttacactcttgtgctatttgtctcttgttttggtccaaagacacgtcatttgccttaattcataacatacaggcaggacatgaactcaaaccagatttactgttttagcaagttctgtgcactgaaaatcattatcctgacatatgtgactttgctcaggctttatcattaccacagagatgttagttttactaatttccaaagattcatttctgaatattatatcagctgtatttacagtccgatatgaatatttgcagtgggggattgcatactgtgtcaaaggggggcttaaaaaggagcaagaagcaatgaaggttggtgcttcttttccttgtagattaaaagaatgagtagatttatgaggctagaattatcttgacaaatttattttgcaattcagtacttggaaagaagagagtgtgagtatgaccagaagatctctgtggatttctacaaggtactcgttttgcatcaggcattattttagaaaataaaagtcaattatttgcattactctaatatcctattgttgaattttattgtttaggaaggagattctttgaagccagctgtgacaggtgtactagtgtaagggttcaaactgcacgattgaaatttccatgatataacttgttaattttctgtttaactcacttactttggtgcttgtgcagctttgtatccactcctgatccagtaggcaacaaatactatcttgggcctgctcctttggaggacatggcaaggtgggctattcatctcatggtgcacttttactggcttactgcttgattagcatcattttctgactacttgatcattttttttaataccaggcaaattgctacagccaatggccccaatgggaataacagggattacctgttctcaatggagaaggcattgtccaacatatgtaagaaaaagatctttttacgatatctttatttgatcaaagctcatgacatactcatttctaatattcctattcatttttttatataaaaaaaatgactgcatcagttttcagtacatgtatgtgctagttgatggcctgctgcttatatatttggacaacaggaccgcactcacagagattttcatagtataattacaaatgatgctacgttgctttgttcaggccatgaagatgattcaatcatcgagctagctaacgaggtcaggaaggtgttgagccggccgaaggagaagatcactggctccgatagcccacaaaaatctcacgctctcgtacacctgtctgcgcttcctgagggcactgttgtggactcaagatagcaagctcggcggtggaagagatgagatctcctctgacctactcactcttgacgctggattgaacgagtttaacagtctgcttcgagctccctggcacactggggaaccagaatgtgctgattttctttcgcaaccgctgcggcaatgctgtaactttcattttgctaatactagagccgagactggtgtgctgctgtttcctttgacacactaaataataaagggattccatgagcttttcactcttgagctgttgcaacttggttctcctcgattgttgatatttggagagttgtaggagagctcgagaaaatgaaattttcacctatccatgatttccccgttgtctacacatcatctgtgcacatgaattttgttgaacagatagatgtaaagcgaagttctgtataatagcatatcagttggcatttcccacgattgacaatttaggagaacgggagaaccgaaccatcgcgaatgcgttttcgtggtaggtgaagaagcctgttgtagtgggaatcagatcctctaaagtcggacaaatcgacttccctctccagtcactcatctggaccatccgatttggatctaaccgtgagaccagcaaaacactaaaacaaaccaggcctgtaaccggcccatatctgcccaatgactagcgtcccggactctggtcgactcgttctactccgccgccgcgatggccaggtcagcgttcccctccacgaccggccgccaccgcgacgctcggcgctccctacctcaccccggaggtccgccccggcgagccagcgccccagcgatctgcgccccgtgggatattgtgaatgaaatccaaaagatgtttgctgattactgcaagctcatatggctgcacaaaataattgcaagtccgtaacttgcaactttcatatggcattatggctcattacacagaactaggaactaaaactgtctgaacatgatggacaaggaggttgttgagccatactcctgagtgcatatggggtataatctgtactactagaattcaccaataacaataacagcatctgtcattgctccctgataattagaaaaacaaaattcaacataatggccatgtatgattcagagaaaaagtgtattactttgaaatattaccatcaatagttcagataagctattgctgaccctgtaggattcagagatcccttcttcaggcaatgatgtatgattcagacatgtattttgtattgctgcacca

SEQ ID NO: 828 - DNA, 5907 bp, Oryza sativa; identical to SEQ ID NO: 523

SEQ ID NO: 829 - DNA, 3580 bp, Oryza sativa
cgacttgcacgagaacatgtcatcaatcatgttccatgcctgggccgccgtcctagcgccggccacttgttgcagcacctcccttgatagagaggagaagatgaatccgagcacttgctggtcctgaacaaaccatgtcttgtactcagggttggggatgacaatcttggtcttcttgtccttgtcgccgtcttctttttcaatttcagccgccggagctgcggtcgtgctgacgatgtgctcctccagctgcgcacctcgcaaggtggtgaggatctgtgcagcccagagaggatgattctgtttggttagcttctccgagatttggaggccaaacagagggttggagattgccgccgccatagaagagctcgccatgtcgctgggagaaagtttgcacgacagaactaatctaatctagcgggaggctctgataccatgtggagataactccttcagcgaggagtttacgtgttaattacttgccacaaaaccgggcttaacagaatacaggtatatatagctcggatagagttgttgtgcatctactaaaacataggaaacttatcttatctatctaaacagcccaacaactcttatccttcgctatttgttacattattatatgtgagaaatatctaacactactccacactgtccacaattactgcgaacccgcaacgcaccaaaagcccctacgcgccactcgcagtttagcacgactacgagatgagagcacgtagcatctacgagcacatgccacgcatgcaccacagtccacagtgctatgtactactcccacctcactcacccgacgcacgcagcggcacagagccagccagccacccacaacacacacatcacactggccgtcctcctcaaaagccgcgccctgcctgggaaggcggaggaaaacgtgggtccgaaggtggggacgccaccaccaccagtagaatctagccaatccagttgcaataaagtatgcccctcccgtaccctcctcgtgagctcgcccactgcgtccccaccacccatacacgccgaagccccacgagagggaaagcacgctactgctactcgtcaccgcagcgcacgccactagactagctagagctagctggctacgctactctactctcccctccctctcattagtcaatactgtagctgtagtagtggtagcacccaacacctcgccattaaagaaacttgagctcgccaagtggagaaaggagaggtggaggagaggaggggaggggaggggaggtgagggacggagctggtgggtatgacgtccggggcggcggcggcggggaggacgccgacgtggaaggagagggagaacaacaagaggcgggagcggcggcggcgtgccatcgccgccaagatcttcacggggctccgggcgctcgggaactacaacctccccaagcactgcgacaacaacgaggtgctcaaggcgctctgccgcgaggccggctgggttgtcgaggacgacggcaccacctaccgcaaggtcagttcatgcttgcccgtctcgatctggtctggtcgtgttgctgtccatttcttggatcttggatgtgtagatctggccggagctgagctgagctcgtgtttcttgttttttttttggtcgttgcagggatgtaagccgccgccatcgtcggctgggggagcgtcggtggggatgagcccctgctcgtcaacgcagctgctgagcgcgccgtcgtcgtcgttcccgagcccggtgccgtcgtaccacgcgagcccggcgtcgtcgagcttcccgagccccagccggatcgacaacccgagcgcctcctgcctcctcccgttcctccgggggctccccaacctcccgccgctccgcgtctccagcagcgcgcccgtcacgccgccgctctcgtcgccgacggcgtcgcggccgcccaagatcaggaagccggactgggacgtcgacccgttccggcaccccttcttcgcggtctccgcgccggcgagccccacccgcggccgccgcctcgagcacccggacacgataccggagtgcgacgagtccgacgtctccacggtggactccggccggtggatcagcttccagatggccacgacggcgccgacgtcgcccacctacaacctcgtcaacccgggcgcctccacctccaactccatggagatagaagggacggccggccgaggcggcgcggagttcgagttcgacaaggggagggtgacgccatgggagggcgagaggatccacgaggtcgccgccgaggagctcgagctcacgctcggcgtcggcgcgaaatgacggccattattgccgagcaaaaaagatggttcctttcgtggacctcgagcaccagctgatcatggttgttgttagatcagtactggtcaatgtgtatgatcatgactacgcatcgatgctgcgatttgggcgatttcattctagccttaggttaatcttgttgttcaattcattcttcctggacttgggaaaaaggaagcagggaaaaattgttcatcacggctgattttattcacggcttcactgttcatctctgtgtttcttcttcccgtacctgtcatgtgcatctcctcaaaatgtgtgacatcttagcttgtgagtagagtgaggtaaaaaaatgcggggggagatgatgttcaactttatggcatgatcgctttgacgtaccgttaaaccagtacagtgagctcccggtttactgtctcttttaacttattttcgcttacttttgctttctttacagtttagtgctacgtagaaatgtacgacggccaatgggactatacgagcaaattcagaacgaatccatcagattcgccaccgtcactccaacgcaaacaatggcatgtctgccgcaagcacgggcattttgtccgcttgcatatcaatattcactggctgggaacaagccttgcaggtagttcgtcttttatcttgaagggacaaattttgatctaacttatccattatctgctgcactactactaattagactggccagtattactgcaggctgtggatggttattggaataccaattagggacaggaggtattgcaccaagcactctcttgcatgcttgatgtggccgtggggattggaggtgccgagggaggggtatctccaaatagtgccattgtacagtggcgcaatgggcacacacggtcgcacggacggccgctttctaggggctaaagctggtcacctcaaatcagatcccatccactgcgcctagtgtttttttctctttctgcgacgccatgcgcttcggtatggactcgtggttgctcgtttcgtatctacagtgaccatatgtggcaggcataattggctcgggctagtacacatctgtaatagcggacagggccacggatacacacatggtctagctaaccaaagatcaaatggcccaatgatttttcgatataaaaacggctcgcgactgcctaaaatggcacgttctgtagtatatcgtagtacaccatacgcgtccgagtccacggaaccccagccaatctactacaccgtggtttgtgcggtgtccgc

SEQ ID NO: 830 - DNA, 6076 bp, Oryza sativa; identical to SEQ ID NO: 278

SEQ ID NO: 831 - DNA, 10167 bp, Oryza sativa
gctaaagaaaatttgtttgtgggccttgttcacgtcgcttaggctgggttccttcatttttgcttcccaacacgaagagtgcacacggaaacggaacaggcaattggcacgtgattaattaagtattagctatttttttttcaaaaattaatcaaatatgattttttaagcaactttcatatataatatttttataaaacacacaccatttagcagtttgaaagtgtacgtacggaaaacgagaggggagagttgggaatcggctggaacgaatgcagccttattgttgtgttagccacactcgcaaaaaattaaaaaaaaatgaaatttaattttagaagttttgtttatcgcaatttattttactaaaatggctttcaaacggcaaacaacaaaatactactccctccatcccaaaatataagcatttttagcatagtaacatgtcaaacatttttaactttagccattaatagcaaaataaaaaggtcaatcatgtaaacaaattatcataatatacaactcttttatttaaaatatcttatttttataaatattagtgatcaaaatagtatctcagagaccattgccaggatctataaatggttatattttaggacggagatagtatatagtaataaaatattttattttgggctgaatcgttttttttgttggtgtgctttgaatgcacaaggcatgtcccggtggtgctcgcagttgcagttgcttcgctttggttctcccaaaaaattgagcaccacaaataggggtgcgctcggctcgtggtcggctcgttgagaaaagctaacgagctgagccaagggtttagctcgagctggctcgcaagctgctcacgaggccaacgagccagagaaacaccaggaccaggagtccactccgagccgggctacctaaccagaaaagcccattagtggcccaatagcctatttccttgagtaaacaaaccctagaatccctaattcacagagaagaggcacgcagacagtaaggaacacaggcgccgcggccacaacccacacgcgaaccggcgaacacgagcgagagtgcgagagcgagacgcatcctgccaccaccggcgaccaaggcccgcagcgagccggtcgcacggtggcacctcgcgtcctcggcccctcctcctcgccatccgcccatccctcgtcggtcgcggcctccccgaacgagctggctccgagccgagccagctcggtacactaacgagctggagcgagccgagccgagccaagatatccacccctagtgtggccacaaacaacaagagagagcagacaccaccacaccatccaaccaaccaaattcctctctcctccgccgcgcccgcgccgcagcaagcaggagggcctccgcccgtgcgatgccggcggcggctaggctacgggcggcccggtgatggcgaccttcttccgcagcgccaacctcgcctccagggtcttcgaccgccagttcctctccccacgccccggcgctactgtacgcccaccgccccccattcctttctctttctacggactatatattgactagtattcctttcttatttgctgccttcctttcttattgagtatatgcctgacctacctacccacatagaatttcccttttctcgcttcaacaattgtcaattcactattatcatcgtcacacgtctcgactactagttcgcatcgcgcactgtctattcaattatactagcagatttcatcatcttcttttttccccctcttgttgacaggttaacactgttagacagttctatgagaacttggttccgagttacactatatgtgacatagattgcccagattattcatttcgtaaattcactgatgatggcaactatcttgtggcttttagccggaaccaccaagatttaatcgtgtaccgtcccatctggccaacattttcatgcaatgagccatgcgactctcatgatcttccacccaaagcaaagaaattcgacagcttctttaagcagctctactcaatttcacttgcatctagcaatgaatacatctgcaaggactttttcctttacatggagtgccatcagtttggcttatttgccacatcaactgcacaaagcaacgattcaagtgccactgagggtgctattcatggggtaccatcaattgagaaaattactttctatcttgtcaggtacaatcatcttgtttcgctaggaatgcacttttagttgtccgttatgatgtctatgtattataaccatcctttcctttcgtttgaatggttctcgacttctatatttctcttgttcaggctagacgatggcgcaatactagatgagaaagctttccgcaatgattttatcaatctggctcatagtattggagcttacttgtatgaggacctgctatgcattgtctctcttcgatatcaaacaattcatgtcctacagatacgagattcaggcaaccttgttgaagtacgcaaaattggtgcattttgccaggaagatgatgagctatttctccattcacatggtcaggtacctactgatccctacggcaagattgctggatctatatttagtttacatcatagttggtactggtcatgtattacctgtctaatcaaattggtgttgattgcactggaaccatgggcattcatagttcaaataatagtaactagaaagaagcacgcgctacgctgcgtgtgatctaacaattactgtttgcacttaaaacaaaaatcatctttcaccatacttcgtacttttctttgctctgccatccaagcatgctctgtaatatgatcaaattgtaaataaaaaaactaaattgcatcattaaggtaaaatatggtataaatttatcttgcttcccccaaaagatagatatcaccgtaacatctgaacttaacatgttcaccaatcctcgataatgcaaagggtaaagaatagaagatatctttgcattgatccaattcaagattattcaaaattgacttcagagtcaggataacacattagttacactgaccagatataatctgatatttgagatttatttgattgaggaatttttttcataaaaaagaattagtagctatggccagtaaagatccaaccaccagcttgcaggtgcttgagatgtactgcacgcttgctgatccctatcaccatctacaatgataataataagagcaatccatgagaattggtctagacagtttttacaatagaaggtaaatatgcccacaaaatatatagagaagttggtaagggaagcatgactaactcaaaaaactaaaatatgtatggctgtgaagtagggagaaatggtgtttccatacgacttaactaaaatgcctcatttgtatcacaaagaactaaactgcattgtaataattaacctagtgaaaacttaatatgtggtagaaaaataacagatcatgtagttagtgaaatatggctatcgttccatattgagaaggaaattattgctcaggtaagtggtcatgcaatccaagatataccatataagcctctatcatcttagtgtgcttggttcttcaactgatagcttcgttcattattttttttcatgagctgaggacaatgggttgcccctctcaacaaaagtaggagttttgttttgcaagaaggatctgtcaccttgcttgtctcaagataaagaacaactaagacataaatataaatcatggatgctgtatacaaaagaacaattttcatgaactcctatccaaaaagtaagtacacttgctataacaataggatattttgtaaagaaataggaagaacatggagccgatggcaactatattagtggtacatgcgctcatgtgtaatcaaggaaaactaatgtatatagacaacccatcatagaatgaagaagcgcatctagaatttctcataggatctctttaaaaaaaatcaaaactgaaaacacgttgcagaacctttcatgtgggtctgaacttatcccacaatcatttatgaatattcttcatttgtatcttgtacatataaattggaagacctacaaactataactgtcactttgtcagataggttgttgctttctcataggtgggacagagcatatacttgacatttgacatcatgatgaattaagcctaaatcattttgctgaaatagaatagaacattgctctggaagtttggatacctcaatataattcaaatgcaagcatcagcagttgctgaaagtgagatgtcttgttcattttccaaaatgatggtcattcaacagtttgtcgatgagataaacattgcatgattgtaatattctgcaaattaaaaacatgatgaaccaaaacttagttgatttgaaaatttaatatgacaactaaagcaaatatgaaagtactggattaaggagctgaattctacaacttccatatacaaagaatggcattatctgccatgtaaatggggtgaaaaccctctgcaagttgacagatcaagttatagtcgaactgcaatacacagacttcttatcagaagttacctctgtccttaaacttgatacctgcaactttgcagtttttcacattctctgatttggacttcaaagattgcaaatatcagctagatgtaaattgcatactaagaaaagaaaatcatataattgaaattaggatgaagcatgaaccaattacctcataaattggaatgtggtctgaatataaataaataatgtagtctctgaaaactgcatcagagtagcacaatcttttgcccatcttttcccctagttcctctattgctcccttctcacttcaattccattgggtctagcagtagcacaatgggatcaccctcctctgctttcttcagtaggaatatcgctgtaaggaaaaaaaagaaagaaagagggcagccgctagcatacctctcgttcgggtggctggatcttccgatgtggcaatgacggctagaagagcgcggtggcggcagctgcggtgatgtcggcggcggcgacgttggcggcggcgacaacggcgatgacggcgtatgcgaggggaggagaagagcgagggagcgggccggcgcgcatgagggaggaggaggcgaggcggcgcgcttgcgcggctgcgggcgaagcggacaatgaggctagggtttggtgcaatctctgccgtccgtttgtgatccgacgatatcacaggtgtggaagcgccggcacggtaggacagatgtacgacccagatcgatcgtagcacaagatcggacggtggggtagctgggactggcacataattaactggaagttcagggacctttgtgcaaaaatacgctgacgtggcgctctaattctcaagcatttccacggcgtttaagtaaactaatatatgagagctactggagcatcaccaggagattatataaagaggagtaatcattccagttttaatgggttgccagataaaacaacaaataggtcaataaccactgatttcaacacccattctttgctgaaaaataaattaggctataaccaagaatatttattggactgaattgatcttctagactgtagcaagcaatatttttggtgctatgttaaaaatagagagaaagaaaagaaaattgtatgcctgcatctgtccaggagtgcttttgttctgacatatttgattatctatttgctaatgacattcttctattgttttcatattgtttctgttatgtaaacggtataacttacaggagactagtgatagagaagcagatatgcacttccccatttgttgcttgaaatatatttctcgtaattttatttccaccatgttcattcattcattcattcattactactagttctttggatttttttttaactttggctccttgtttcccccactatttttattgcacaaaagcgccttctcagtctaggaaaatattcatgtccatgatctattattcttgatcaacaatagttgatattattctagttatgaacttatgcacgataaatctaaatcaaatctacgtatgaatcacaaactgtcaatgtacttgatgcctgcaggctgcacgaggtgtttcttttcttcctggcatcaagcaacggttgttgtcatttatttttcgcaagacatggaatgaggaatctgatcagaccttggttagccatcttttctagttcattcatttggtattagttttgaattaaggtgtgcgttgtcttctgtgccatggtcctgttccaaggttgatcacatacttttgaatattgatgtaaagtagatattatatttaagttgtcccaactgacatgcccactgctaaaagtaatatttataccttttttccatccttctcttgtatatttcctctttcattggtactgttgtgttctgtctttggaacttaatttgttgtggagcaaaatattttgttttaattgtttgttgaaccaatggatttgtttacagagagtccagcatctgaagaagaagttctattttcactttcaagactatgttgatcttatcatatggaaggtacctacatacatccactgctcactttgtctcttactctctttccctacttttatttcttgaaaagtttcttaaccctttacctggaaccaatatagttaattttagctaactctcagtaataacacaaccttgatgatagagcatgtgctgataaccaaacattccatattctatcaaatatacatatatatatttttcgtaaaggtgcttataacatgatagttgaacaggtgcagtttttggatcgtcatcacctatttatcaagtttggtagtgtggatggaggggtaaatccatttttccagacatcttaccagtcagttgtgcataacctgatgtcatttaactgtaagtacatttatgtttctttaggtttctcgcagcactgaacagaattcagcattctttgctgtgtacaacatggagacgacagatattgtttcactctatcaggtacctattctcattgaaacatgttgttggagttgtttccgtttgttacgttgagcttattatgcaatttatcaacagaattcttcggaggagctctattcattgtttgaatatttttatgaccattttcacacaaatccacaaaattcatcgcatggaaattttatctcgtcacattccaataatgttcatgctctcgatcaacttcggacaattaaaaataaagcaaacagcacctcacaggtaatattgatagcatcaggggtatgatttttattttttgactcactacagttcttggctctgttagtctgtttatattgtttccacaagatgtgagattgtttaaaagttattgtgctaatgcctacatcttttgcaatgttctgattagaaaccgtacgagtttcaattattaagtcaatactgctcagttctacatgcttggatataatgtacagcaacactaaatcaccaacattgaactgaataatgtagagcaacgctaaatcccaaatgcataatgaaagttttcttaaacattgaactgaaaattttctgaatcgtcttggcattgaactgtatgtgaggaatttaaaaggtatccctgtattaccgttaagccttgaaccttgtgagcttgagcagtcttccagtaagggcctttttttatgtctgcttctattaacaccaggacaagtggtttgcttgtgaaaattttagaatgagccaaatctttgtgatgaaaagctagaggtgtgaaattactagttgatgatctttgatatttcttgaaatccacatttattttatgttactcttactatttatatatggcataaggcatatgctaactaatttgtgatgctgacttttggtaaatgcctgctctatatttagcagtttgtgaaaaagatgatggcgtcactaccttacacttgtcaatcacaaagtccttcgccatactttgacctatcattgtttcggtatgatgagaaggttcgctcttcaacttgtttgaaataattatacatcagaaagcagttgatattttcgaaatttatttttggctacttttacagtttacagtttacagtcaagttcaaacacatagaagatgctaccttgactaacaaatatgtgacacaatcttctctaaatataagccatgcgaggcacttttgtctattttatcccccttttgactttgctaaataaaaactaccactggcatgaattatggttgttcttttccatgtgggcataactgaagggtaagaaaatcatctacccactttcataggtccctttgatccactcctatgaataaatgttagttttttttcttattgttatttagttcttgacatttccttgtccctcgttttcagctgatttcagcgattgatcggcacagacactgtacagagcatccaataaaatttatatcagtgaaacagccaaatgttgtcaaattcaagataaaaccaggtatttcttactagatcatcgtcgttagcaattattatctagattctgaagttcgtgcttgtatcttcatataattatcaaggacattgtgtaatattacaattacgaaggccgcatcatatgaataaaccaaaataatggttaacatgttgtgaacatataggcatactatatggctgagtgtagaataagttactttcgagtttgatctattttttgttggtcatgtaaatcaaaatatccttggtttaaactttgcaggttcagattctggtgcttctgacagcagggcaaaaagaatatcttccttcttgtttcacccatttttccctctcgcactttctattcagcagacatatatgcagccaactgttgtcaatttacatttcaggagatagaacgatattgccgttccctcaattgtatttgtaacagttgtgagcggtgcacagctcagtaaaaattttggccgcttgtagtaggatgttttatcggcaaagatcttattataggcaaaggaaaaatgtgggtttaggttctccttgcttcgagtatgctggaatgtacattttgtaggaatatggctgtctgaaggtaaatgtagttcatctaaaaaaggaaggtaaaatagagttaacaaaatgagcttttattttgaattcatttcgctgtcttcccctcctgatcccgaagccttttcctaggggcttagctcaatttgtcactgtatatatagatcgtccatcttgcaacaaggcttgaaagtgttactattaaattagttagtttttttttgatcggttcgatgcgatcagtgcaattcttgcctatgatgattgaccccgagataaacatcaatagttgtttatctaagggctgtgatctctgggtttatgggcttctgtagttaaccatttatttagtccaggaaaccccaggccttgatgatagagtccgtctgtgttgagtgagtacttttgttaataggtgggctcaaaggagagtaattatataagacttacagcgatgtgataaaaggacatcgaatgaacattatgaaccctccgtcccaaaatataaacatttttagcatagtaataagtcaaacatttttaactttgattattaatagctaaaaaaatagaaaagatcaatctttaaaattgatgttattagatttattattaaacaaactatcataatatacagctctttttatttgaaagcattcggcaccaatactcaattaactcataattaagcataaaagtagccttattcggatcacgccacacccagacaattcgcccattgccaatacaccatatgatggattccttggttttagttagtcgctgctcattctaatatcttacttttataggtattgttggtcaaagtagcatctcggagattgtgtcagagagtctaaaagagtttatatattgggacggagggagtatcaaactatccccatgttgacgaaaaaatcgaacccaccggtctaggagatctgcttagctccagtgcaggtccaaaagttgttgagatgcgggcgtgccagtcagtttgatcctgcaactaacaagatatgtaaatagtagatcaaaacagccgatcggctgacaagccgatggggtagttccagccgatagctgataat

SEQ ID NO: 832 - DNA, 4443 bp, Oryza sativa; identical to SEQ ID NO: 317

SEQ ID NO: 833 - DNA, 7556 bp, Oryza sativa; identical to SEQ ID NO: 330

SEQ ID NO: 834 - DNA, 3704 bp, Oryza sativa; identical to SEQ ID NO: 747

SEQ ID NO: 835 - DNA, 7812 bp, Oryza sativa
aataaaaatcaaccaacgccgatttctatataacaaaacacaaatataatacattgcattttttacatagttctctacaggtatttcatatgactttagcgggtgtttcatactaggatctagtttgtttcatgttgtagccaggggaaaaatgtacataatttcaaattagtaggcatgtttttattatgacacttttggtctcctttgaaaatcagcttctgaggaattaagtgagaattaaactaattctagaaaaaaaaatctagtaacacgttgcacaagagtccaaaaagtgaagaccagaaatagacataaccaaataaaaaacttaacttatatatttgccgatattttacataactgaaattatggtattgatcgtttttttttcaaaattttgaccactaatagcttctcaaatgattagcccccttgatttaagcaaaaaaaagaattttttaagttttttttaagattgtagtactataggatttatttttctatatggctttttgacacaaagtattaaaaactattgaatcctataagattttaaagttctaaacaatgtttcaatccatacaagttttgaatgatttttaacatgaggattaaccttatgcaaagtttccaatgagtttgtccccctcatttaattcctatgtctttcctacggcgcaatcgaacgacaattcctatataactatatatttcctatgttttataatcctttactttacacctgaattcatattagaatcctatatttttttcttatacctccgttttctcaattctacgtttcaaaactctcttatgttaaaaatgataaaaaaaagaactatttaaaaggcatattaccaaaacaccccctctatataatgggagagtatttttttctctccacgggctccaccagtcaccacagtactgcacaactactctctccacagctcgtatacaagagaagagagactgttcctctctgctctgcttcccctgtccaccactattaaaccaacccccaccccttctctctcctcctctaccgtccttcccttcttctctctcgctacctttcccttcccacctcctcctcctcctcctcaccaccaccacgcgcctccgctcgcaagaagcacctccgaccgccatggcgcgcgcgggagctggcggcagtctctccctggaggcatgacgcggcggcgcccgtggccgtggctcctgttgctactactgcgaccaactactgcgctcggtcggcggtggtggtggccctggtcgtcgtcgtagcgcgtcggcggaggcgggagaagaaggagaagggtcgacggggatggcggcggcgatggtggcggcggtgcatggagtggggaggcaggacaggtcgtcgcctggcggcggaggggcgccgcaagtggacacgggcaagtacgtgcgctacaccccggagcaggtggaggcgctggagcgggtctacggcgagtgccccaagcccagctcgctccgccgccagcagctcatccgcgagtgccccatactcagcaacatcgagcccaagcagatcaaggtctggttccagaaccgcaggtgcgtgccttctccttcttctctccacttctctcgatccgctgctcactgcttccttccacatgaatttcgctttcttggcttctcttggctcttaagattttctgtgtttatgttttccattaaagaagaaaaaaatatcgtttcttattagagggaaaaaaatgttttggctttcatctttcttgtccttttcaggattcgtatgtttggtttagtatgtggatgcaggcacctagtaatagattgttgtgccaaaatctgagtttcgcgttggctattttggtctaagatgcctgagtttttcttttttgtgatcgagttctggtctattctttgaatgccatctcgaattttcttttcttattcttttttttttgccgtttgtgtcgtggtttcgtggtgggggacgcagaagcggatgagtcttttcactcttgagtgctctgctttgagctagaacctcgcgagctgatgtgattctcagaggctgtcttgacatttagacatgattgctaatcttatgttggttggcattgcaagagcaactgtaaaagcaaagttaaagggtcatcttacccaacgcagcggtcagatttaagccagatttggtgttgcaaggatgtatgcatcatcatcttcagctgagaaaaaataataataattcgtactattatttgttcctgcttatcagtcattagttgctttcatgccatgaaaatgtgcagctgggatgccttgccctttacctaacacgcttgatgcctcacctgggatgtgatatgcctgttctgaggcacagcattgaatcgaatcttgtacattaaggatcgttgccacagtttcttccttgcaaatgatgtttttgtaactgtgtggtgtggtgtggccgacagttgatgatgtttttcctttgtgatttgcaggtgccgcgagaagcagcgcaaggaggcatctcgcctgcaaactgtgaaccggaagttgactgcgatgaacaagctgttgatggaggagaatgacaggctgcagaagcaggtgtcccgcctcgtttacgagaacgggtacatgcggcagcagctccataatgtgagattcatcatctttgctaatctcatcagacataactcatgatatgcaagtgtttgcctcagaggcatgatctgagtctgagttctacaatggcaagcgatgtgcttagttactaatttcaagttcaacagactaacgtgctgagtgctcctagcatctcctagaaatagattccagtgtgtgtttaatctttttaatttaatgttgttcgtattactggttcctgcctctaatgttgtgtgctatgatgtttttacagccttctgtggcaactacagacacgagctgtgagtctgtggttacaagtggtcaacaccaccaacagcaaaacccagcagccacgcgtccgcaaagggacgcgaacaacccagctgggtaattacagtgctagtgtccttaacttttctaagaacatttgtatgcctacccttgcattgcgcgatcttttgcttaagtttgatgcaactctttgtttcttacagtctactcgctatagctgaggagaccttggcagagttcctgtcgaaagcgacgggtactgctgtcgattgggtgcaaatggttgggatgaaggtaatgtaattatcgcagaaggcagaattgtgtgtgtttattacttcagttttttggagaattacttaaaggtggaatttgttacagcctggtccggattccattggaatcatcgctgtttcgcacaattgtagtggcgtagcagcacgagcttgcggccttgtgagccttgagcccacaaaggtatgttgtttttcatcatcacacagcccaatgtctccattcggcagacactcctaatagactactgcataggttgctgagatccttaaggatcgcccatcttggtatcgcgattgccggtgtgtggatgtgctccatgttatccctacgggtaatggtggaactattgagcttatctacatgcaggtatgcgtccttttacgacatggttaacattaggtgcgctttgatactgtcctctctgttgtctatagctgtaacctgactgttactgcaattcaatttatcagacttatgcaccgacaactttggcggcaccacgtgacttctggatactccgttacactagtggtcttgaggatggaagtcttgtggtattccttctttcctttgattgttacggtgcttccatttctactgaattgttttcagttgtgttttgtgtgacttaattggcttagcttaatattgtttgtgttcagagttggtaactgttgctcactaccttgttctgtagatctgtgagagatcattgactcaatccactggtggcccatcaggacctaacactccaaactttgtcagagccgaggtgcttcctagcggctatttgatccgcccatgtgaggggggtggttccatgattcacattgtggatcatgttgatttggatgtgagctgaagagacatttgtccccatccattttttggacactttggtcaaatttgtggactcttagcaataacatattttcttgttgcaggcttggagtgtgcctgaggtccttagaccactttatgaatctcctaagatccttgcgcagaagatgacaattgctgtatgtttaacagttgcatttgtgttaagatttcattggtactaagtgttctgtattgtgttaatatatcagtgatgcctgacaattgctggtttgcttttacaggcactgcgtcacattaggcaaattgcacatgaatcaagtggggaaatgccctatggagggggccgtcagccagcagttctgagaacatttagtcagaggctaagcaggtttgcagtagtgcttatgtgtcactatgtgaaagagatacccatgcgtgctatggctaacgtcctcgatgctatttgcagaggcttcaatgatgctgtcaatggattcccggatgatggctggtcactgatgagcagcgatggtgctgaggatgtgacaattgcttttaactcatctccaaacaagcttgttggatctcatgtcaactcctcccagctgttttctgcaattggaggcggcatcttgtgtgcaaaggcatctatgctgttacaggtctttactcataatccatctaggtaattattgtgcatgagtagttgagttgtttattatgacctgacaagcttgttttcattgtgtagaatgtaccacctgctctcctagtgcgatttttgagggagcaccgctctgaatgggctgatcctggtgttgatgcttattctgctgctgcgttgagggctagtccatatgcagttcctggtctgcgagctggtggttttatgggcagtcaggttatattgccacttgcgcacaccttagagcatgaagaggtaactgatgttagctttgcttcttataattgctttgtagcactacttgcgaaccaatattcgaactaacccttttaaattgcagttcctggaggtcattaggcttgagggacacagcctctgccatgatgaggtcgttctatcaagagatatgtaccttctgcaggtatattttcagagagcattagtgtgcaattttttcattcaatctgttgttggattaacttgatgaggtactatattctatttcagctgtgcagcggtgtagatgaaaatgctgcgggtgcatgtgcccagcttgtctttgcacccattgacgaatcttttgctgatgatgcaccactgctaccctcaggcttccgtgtgataccactggatggcaagacggttagtgtaatttcttttgctctggcagctggatcttgtccgatcgcctaaactaaacaatggttcggtattatgtaccctactacaggatgcaccatctgcgacacgcacacttgacctggcatctactcttgaggttggatcgggtgggactacacgggcttctagtgacacctcgagcacctgcaacacaagatcggtcctgaccatagctttccaattctcatatgaaaaccaccttcgtgaaagcgtagcggcaatggccaggcagtatgtccggaccgtggtggcatcagtgcagagagtggccatggcaatagctccttcacgtcttggtggacagattgaaacaaagaaccctccaggatctcctgaggcccatacgcttgcaaggtggattgggaggagctaccggtatgactatctttgttctataccatgtgactatatttgattttgaacatttattcctactattagcacaccaatttgtcagtattatcctgggatatgatggtgcatagagaagtgatagtaattcacagtcattgatgatagtatggatcattttcaattctttgcaatgtggtaatttggtttgctttaaaatttcagattccacactggagcggatctccttcgcacagactcacaaagcacggattcttccttgaaagcaatgtggcaacactctgattcaatcatgtgctgctccctgaaggtcagtgtggtgcgcctttttgtattgtcgctgatacatatttacattgccgttatctaggctaacaaacaaattctggctactgcttaccattcaggctgctcctgtgttcaccttcgccaaccaagccggcctcgacatgctggagacgacgctgattgctctccaggacatctcgctcgagaagatccttgatgatgatggccggaaggcactatgtacagagttccccaagatcatgcagcaggtatggactattgttcctaatgctacaagcctttggacaaacccttctgtgatgcttgtaaccgaacagcacaaaactgtttccactccagggtttcgcctacctcccgggcggcgtgtgcgtgtcgagcatggggcggccggtgtcgtacgagcaggcggtggcgtggaaggtcctgagcgacgacgacacgccgcactgcctcgccttcatgttcgtcaactggtcattcgtctgagaaccaccctagtagaatcgatcccccctcttgtttgtctgtcctaaagaccttatgtagtattgcttttgtgtatcatcaccatgaacatgtcaagaacctccccagtttctatcatcatgaacttccgtttgaatctagtactgctaaatgatctatatggtatctttatctgtgagtgatttttgcgtgtgaagtttgtcacggaaggaaacccgatcagtgtacagcttgtgactggtttgttgccagttttggatgtgaaatgcgtgatgtgtggccgtgtggcgacctggtatttggtggtggtggtggcaacccaaactgatgttgatgttggtttggttcgggggtcatggatggctagctggctgggctgaaagcaacggtcatggacacctggggatggcgacgccgcgccagtttttgaccggttttgtgggggaggagaggggagagagctctgctgaaacgtgggcggcgtgtgttgttgttgttgttgatagactcttgtgagttgtgacatctatccttgcgatgatggaaggcaaactatgttgtactacgtactagagatcacatgacattttttatcttcatctttacatcttaaaaaaattgattggtagtgtttttgtcgtccatcaatccaacagatccaacgaccagattactactcctaggctcctccccctcgcttcccgagttggagtcggagttgagcaggaaagaaaccatgtcacggagagggaaagaagagaattgatttgttgatgaatcggatctcaatcacccttaacaaaaatcagtattaccaaagaaaaagaaagagatcgattggttgatttcttgggctgaggtgattttggatacgatggacagatatgcgatacatggcccatgtgtagcaacgtgcggcgagaagagagctcggtcagtgtcatcttctttgttgcaacgtacgagtatttttgctagtgtagtacgtataaatcatatattagtatgtaaggtaaacctgaaagctatcatagaatgtaaaatagaagtctacgttagtcttgttacttgcactatacatttttcctggatttacactgcatatttatgttttggatggaaaggatggggggaagaaagagttgcatcggagcaagcaagcgagggactcgtgagtg

SEQ ID NO: 836 - DNA, 6370 bp, Oryza sativa; identical to SEQ ID NO: 353

SEQ ID NO: 837 - DNA, 13214 bp, Oryza sativa
acttacaaaatgaaatctagaggcacgattggaaccaaagaatttactttgttttaaccattttggagctttatccagcatagaaatgaaaacttacagcttgctgtccatttcatttgctcctgattattttcttcgtttcttttctgctataggaggcataatactcgactagctagtcagaactgttcttgggaatcgcgtgatgtttgcagaatttgttttgtactaaaaaaacttatgcaaaaaaaaatcccaataaattttcactgtactttctctgtctaaaaaaaactcaacaaaatctgatcaaccctttattcagatttattacactagctctcctaagttaatttttttaaggacggaggaagtacaggggcttgtttaggggagcttctagctaccgcagcttctcctagaatcagaagctccccaaatagttcagttttttttgtccagattttaagaagttgtagttgcagaatctagaaaatgaacaagaagccgggaaacctagcttttctagattctcagccaaccagttgtttctcagaattttaagctccctaaacatgccctaggttaaggaggaccggaggaggaggaactcacggagcgatcgtttcgcttattcgtggaataagcgaacgttatatttgtaaaaaaaaagtaatttgtgaataaaacttttatatacgtgttcttagcgatctaaaagcaaaggttgaaaaataaatttcgatgaaaaaaaccttaaaattagctctaaattgaaggttaaaaatttaaattttggctgataagtataagcataaacgaaaagacgagactctcgtaaccctaactaacccagaagggatcaaggggctcacgcagcgccacgtcacgtcgcccccccccccccccccgggtaggcgcgatccgggccgtccgttttgtcgtgggggagagacatggacggctccgaaccaaacaccaacacacgcacacacccgcaagcgcagcgacacatcacacgggctcaacagtgtagttggtgttcctcgcatctgcgcccatggcagccgcagctgcagcagcagcatgatcgccaccaccaccacctagctcctcctctcccctccagattcccagcactctctccctctctagacccctctctctctctctctctctctctctcgctctaggcctctagggggttgtcggcgtgcgcacgcgtacacgcgcgcgcgggggggggggggggggggggggaagaggagaggaggcctgcaaagctggcgcctgctgctgctgcgcctgcgccctgcctcgcccaaaacagtggagattcccgtatccatttcccaattatggggcggggcgaggaggctaggaggaggatagggtgaggcggctcttcacttcttcagaggtggcaggccattctgcttctctcgccattggagtgctccgggtgaggtgaggtgagcggctcgagatcctgccaagatcagctccttggcctgggggtggaggacaggtggtatcttgtgccgtctttcttgagttcttgcggtggttttctttttttgaagtttgttggtttcttttcttctttttttttttgggttggttcgtgatttttttgttgttgtgatggcggctgagttgtttgtttagtctgttcttgatgtttgcttagtggtggtactgatgtgtgggtagggttcgtgttcttttttttttgcgtttatcttcgctttccttttttttttcttcttccccttttgagatttcgatcgtagcattggttagcgtgttggtggatgtagttaatcaatccccttttaggtgccaaatgtcatggaaagcgagctctttgcccttgtttaaccaagcttttgatcgcagcattcaagaattggctccatctccccgcaaaaaaaaaaagaaagaaaaaggaattggctccatcgattcagtaaaaaaacccgaatgccgcggaagttagcattgctcatccgtggattcgacgctggcacactggtttcttggctagagagaaacaacgatgtgcttgctgtttcagccaccaatttcttcccggcttgtgatttttgccttttgtatctgctttctttttcctcttttgagaaagtacacgattcctttgcctaccttcattttcagtgccgattactaaatttgcagtaggtcctactctctcgccgtggtgttggactatcattgggagtagttgtcatgtggatttatgcccatttgctgcgattaaagagagaatatgtgctacgccttaacgttcatggacctgatttcttgaggtcgctgtaactgttgcctttggagaacaagaggaagagggtgtgagtgtgtggagacactaaccgtggcttttgcagattcctcttatctgttttccttgcatggcagttgtgccatacattgatacagatggatcatattcttcgtacaaccggattggagtatgctcgatctgtcatccgtggagaacccgaaattcagattgcttttgttttgcgtggctctcctttgcagttcttgcgggaacctattcccccaagaatatcatgctactccacatcttgttgtttattctactgattccatcttttcgttcgggccaggccagctagctagccgcaagcgctgactgtcttgatcattgattcctccttccacaataactctaaaagattggaagcacatttgcatgattgatggttttcccgtcgctttcggcattcgttatctacctgtccattagccttcaggatcatgctttctgacttgcttgttctcattcttagggccataacttcagcttctcccatctataataggttcgcaaactgttcagcacaatgaagccttcggacgataaggcgcagctctccggtttggcgcaatcagaagaatcgtcacttgatgtggatcaccagtcatttccttgttctccatcaatccaaccggttgcttctgggtgcacacacacagagaacagcgcagcatacttcttatggccgacatccaacctacagcattgtgcagccgagggacgtgcaaactactttggaaaccttcagaaaggattgttgccaaggcaccctggtcggttgcccaaaggtcagcaagcaaatagcttgcttgacttgatgactataagagctttccatagcaagatattgcggcgttttagcctcgggacagcagtgggattccgcatcaggaaaggggatctaacagatatccctgcaatccttgtctttgttgctcgcaaggttcataagaagtggcttaatccagcacaatgtcttcctgctattcttgaggtgcggaaacttaatctccattgttgtttgaatttggtttgggacggtctaagtttttctgctaaatctttcacttagttggatcattaacagggtccaggaggtgtttggtgtgtaggaataagtcttggctggttggtcttggtcttgtggtgcctttttcctgcttttcagctttctaggacagcatctctactttcagtttggatgctctaggacagttaggacagcagtttgttgagatgctctaggacagtttgttgggatgctctgctctaggacagtttgttgggatgctgacagcaccctcttagactagcatggctgcatggctgctacaagcagctataaatatgtatccaatcctctttgggaggacatggcttttgtgtttagtgaatgaagaaaaccagaaaattgccccatctcgagtgccatcctcttctcaatgagagtaaccattgaaattctaacatctggtatcagagccacactttcctgtaggctaaacatctcttgttccaccccttcccaagctcggttgagctctcagccagcagcagcagcagcagcaccggttgcccctccttcccctttcccttccccctctccacacagcagccccccggaggtgcgccatgtccgacgctcggtctcggcgttcggtcgcctcgagcactcggcgtcagcaggacgccgagctcgccgcagcagaagagcgcaggcgagcaacggctcagaccgctgcagcagcagcgagggcggccagactggcggcagcggagttggcagcagccagggcggaggcggaggcggaggcggcggaagatgcggcacgtgcggcggaggtagaggttgagaccttgcgcagcagcatcaacggctccatcgccggcgacatcaccgctgacagggagcttgaggagctggcaagaggaagggcacgggagcgagcagagcggtgggcagcagcccacctccacggcggcggcggcggcccaagggaccgtgcgcccgccgacgggaacccagacgggcgcgggcgtgccggcggcagcccggagcccgcacgcggccctcgcaggcggcacggctccctctcccctgaccggcgccatggtcaccacggcgtccagacggtggtcagggattttggtcccggcggtgggtggcctaccctcaccaaaaccaactacatcgagtgggccgcggtgatgagggtgaggctccaggtgcggcacatgtgggaggcagtccggtacggtgacgtcgactacgacgaggatcggcgggcactggatgccctcatcgctgcagttccgcccgagatgcagttctcgctttcccagaagcggactgccaaggaggcctgggacgccatcgctgcggcacgcatcggcagcgaccgcgcccgcaagtccacactgcaggcactccgcaaggagtgggagaacctggccttcaagccaggtgaggatgttgatgactttgctctccgtctcaacactctcttgcagaaaatggtgcagtacggcgacgacacctacgacgaggagagagctgtcgagaagctcttccgctgcgtccctgagaagtacaggcagatcgctcgctcgattgaatctctgctggacctctccacgatgtcgatcgaggaggcgttaggtcgcctcaaggtcgtcgatggtgatgagccacggcctctctcggggcccatcaccatcggcgggaagctccatctcactcgggagcagtgggaggcctctcagggtgacgggaggaagggggagtcatcttccccgacaggcggccataagccgcgcaaggcgcggggaggtgtccagctacggtgggcgcgaagacgtgccgagggtggcgcccgcagaggcgcccagggcgttgccaccggcaaccacaagccggcacgagacgacacctgccgcaactgtggcaagcttggccattgggccaaagactgtcgacagccacgacgcggccaggcccacgtcgcacaggtggaggaggaagagccggctctgctcctagctcacgcaagcatcgagctacctccagcggcaccggccgcagcggctttcctccaccttgatgagccgaaggtactcgtctccctctgtgacggctccagcaacgacaaggctgatgggtggtacctcgacaccggcgccacccatcacatgaccggccgacgggagttcttcaccgagttcgactccagcgtccgaggcaccgtcaagttcggggacgcctccggcgtggagatcaagggtgttggctccgtcaccttcaccgccaagtccggtgagcacaggctgctcaccggagtctactacatccccgcgttgaggaattctatcatcagcgtgggacagctggatgagaacggctcacgcgtgttggtcgaggacggactcatgaggatttgggatcgccgtcgtcgccttcttgccaaggtaaccagaggcactaatcgactttacatcctcagcgcgcaggtcgcacatccagtttgcctcgccgctcgtcgggacgacgaggcgtggcagtggcacgagcgcttcgggcacctccacttcgaggccctgaagcagctcagtgccaaggagatggtgcgaggcatgccgtgccttgaccacgtggagcagctctgcgacgtctgcgtggtgacaaagcagcggcggctcccctttccccagcagacgagcttccgagccaaggagcggctcgggctcgtgcacggggacttgtgtggcccagtgacaccggccacaccaggaggacgacgttatttcctgctgctcgtcgacgacctctcccgctacatgtgggtgatggtcctcggcagcaagggagaggctgcggacgccatcaggcatgcgcaggctgctgcagaggcggagtgcggccgcaagctgcgcgtgctgcgcaccgacaacggcggcgaattcacggcagctgaattcgcgtcgtactgcgctgatgagggcattcagcgccactacaccgcgccgtacagcccacagcagaacggcgtcgtcgagcggcgcaaccagacggttgtggggatggctcgggccctcctcaagcagagggggatgccggccatcttctggggggaggcggtggtgacggccgcctacatcctcaaccgctcgcctaccaaggccctcgatggcaggacaccgtacgaggcttggcatgggcgcaagccggcggtctcccacctgcgggtcttcggctgcctcgcgttcgccaaggagcttggccacatcggcaagctcgacgacaggagcaccccaggggtgttcatcggctacgcggagggctcgaaggcctaccgcatcctcgacccggagacacagcgtgtgcgcattacgcgcgatgttgtgttcgacgaagggcgagggtgggtatgggacaaggcggtggatgatggttcgactccgacgtacgacgacttcaccatcgagtacgtccacttcgagggagctgggggagtaggcagctcttcttcaccgagcgtgtctaccccagtccccgagcctccaccgactccaacaccaacacaccctcgggccacgacttcgactacgacgagctcttcgtcgacaccaccccagccggtgtccccacacgctccagcaccaacagccactcctccgggcacgtctactccgacgccagctcgtgttgagcgcagcccggtggagttcgttactccgctctcccacgacggggagcgcatcgacgcgtaccatgacggcgagcagctacggtaccgtacgatggaggatcttctcggcgaccagccggtgccgggactggtgcctcgcaacctggaggcgcagttgcaccttgcgtgcgacgacggtgagcctcggtcttttgcagaggccgagaaacacgcggcatggcgtgccgcgatgcagtcggagatggacgcggttcaggagaaccgcacctgggagcttgctgacctccctcgtggtcaccgcgcgatcacccttaagtgggtgttcaagctgaagagggatgaagccggagccatcgtcaagcacaaggctcgcttggtggcacgcggtttcgtgcagcaggaggggatcgactacgacgatgccttcgctcccgtggcacggatggagtccgtgcgactccttcttgcgctggctgctcaggaaggctggggcgtccatcacatggacgtcaagtcggcgtttctaaacggcgacttgaaggaggaggtctacgtgcaccagccgccgggatttgtgatccccggcaaggagggcaaggtgctacgcctgcacaaggccctctacggcttgcggcaggcaccgagggcgtggaatgccaagttggattccacgctcaaggggatgggcttcgagcaaagcccgcacgaggcggccatctaccggcggggcaatggaggaaatgccttgctggtgggtgtctacgtcgacgacttagtgatcaccggcaccaaggatgcagaggtcgcggcgttcaaggaggagatgaaggccaccttccagatgagtgatctggggcctctctccttctacctggggatcgaagtgcaccaggacaactccgggatcacgcttcgacagaccgcctacgccaagcgcgtcgttgagctggctgggctcaccgattgcaacccagctctcactccgatggaggagagactgaagctgagccgcgacagcacagcggaggaggtggatgctacacagtaccgacgtcttgtggggagccttcgctacctcacccacacacggccggacttggccttctccgtcggctacgtcagtcggttcatgcagcgaccgacgacggagcaccagcaggctgtgaagaggatcatccgctacgttgcggggactctcgaccacggtctctactacccgaggtgtcctggcaaggcacacttcgtcgggtacagcgacagcgaccacgccggcgacatcgacaccagcaagagcacgagcgggattctctttttcctcggcgagtgcctcgttagctggcagtcaatcaagcagcaggtggtggccctgtccagctgcgaggccgagtacatggcagcatccgccgcttcgacccaggcgctctggcttgctcgactgcttagtgatctcctcggcagagatactggagcggtggagctcagggtggatagcaagtccgctctggccctggcaaaaaaccccgtttttcacgaacggagcaagcacatccgagtgaggtaccatttcatccgaagctacttggaggaagggagcatcaaggcgagctacatcaacaccaaggaccagcttgcggatttgctcaccaaaccccttgggaggatcaagttccttgagctttgctcccggatcgggatggctcaactctcccacaagacggcgcacaagacttagggggagaatgtaggaataagtcttggctggttggtcttggtcttgtggtgcctttttcctgcttttcagctttctaggacagcatctctactttcagtttggatgctctaggacagttaggacagcagtttgttgagatgctctaggacagtttgttgggatgctctgctctaggacagtttgttgggatgctgacagcaccctcttagactagcatggctgcatggctgctacaagcagctataaatatgtatccaatcctctttgggaggacatggcttttgtgtttagtgaatgaagaaaaccagaaaattgccccatctcgagtgccatcctcttctcaatgagagtaaccattgaaattctaacatctggtatcagagccacactttcctgtaggctaaacatctcttgttccacccctttccaatgtcttcctgctattcttgaggtgcggaaacttaatctccattgttgtttgaatttggtttgggacggtctaagtttttctgctaaatctttcacttagttggatcattaacagggtccaggaggtgtttggtgtgatgttgatgttgttgaattttcgtactacggtgcaccggctcaaacacctaaagagcaaatgttcagtgagcttgttgataagttatgtggcagtgacgaatgtattggttcaggctctcaggtactcgtgttctttccctctctgtgtgtgtgtgtatgtgtgtgtgtttgcaaaaataccatgtgcattaagcacagcatgccatcatctgcacaataattgtacaggacaataccatgtactagcaattgtacccttcatgttgtaaggggaccgttcaaatttgtcaagattcatcgcaagatttgctagtacaaagtggataaattttcatggcactctgaagattatgccaaaaactgaccgttggtttgttggttagtcctaacatctaagtttgaccagttgagcggtggccacagctagtttgaatgctaccaatgttcattacatcaaagcagatgatctgatcggagattggaaggagtttctccttctaaatcatatcatatcatttgagatactgcatactatatgttggttcttgtgcagattaaagcttctggattttacacaatcctcctaccgtttaccagtcaaacctttaacatgttgctgtgctctttttgtgaaatttcaacttagtaataatattttgtgacatgcactcaaactacatactccctccatcccaaaaaaatccaacctaggataggacaacaaatctggacaaacactttgtccagatttgctgtgacctatcctaggttgttcttttttgggacggatggagtacttctgaagcgttcgtccttatagttctgtttcattgtttcaggttgcaagccatgaaacttttggtactttgggtgcaattgtgaaacggcgcactggcaacaagcaggttggtttcctcactaaccatcatgtcgcggttgacttggactaccctaatcagaagatgtttcatccattaccacccaatcttgggcctggcgtttatcttggagctgttgaaagagcaacttctttcatcacagatgacgtttggtatggaatctatgctggaacaaacccaggtagagcagttacaaattagctggtcagggctttatctacaattgtttgtctatttaaaaacaatgtcttaagtaacattaaaagacacttcaactcactgtataaatataaaaaataagtttcctgcttcctagttcccatcattcatattaatgccggattgcattttttactagttagaaacaaatcaacatttagttttgattgtaaaaaaaacatactatgtttgtgcttttctggtcatttaacacatttaccattttattgattattccaaatgatgtatataccagtctaattcccaaacatatatgccgccccattatggatttgcagagacatttgtacgagctgacggtgcatttatcccatttgctgatgactttgacatttccaccgtcacgactgtagttaggggagtcggtgacattggggatgtcaaggttatagatctgcagtgtccgctcaatagcctcatagggaggcaagtatgcaaagttggcagaagctctggtcacacaactgggactgtgatggcctatgcccttgagtacaatgacgagaaaggaatatgcttcttcacagacatccttgttgttggtgagaaccgccaaacatttgatttggaaggtgatagcggaagccttattatcctgactagccaagatggtgagaagccgcgtccaattggaattatatggggtggcacagcaaatcgtgggaggttgaagcttacaagtgatcatggccctgaaaactggactagtggggttgatcttggccgtctactcgaccgtctggaacttgatattatcattaccaatgaatcactccaaggttgattcttttccctctattcatttgcattcatcttcagatattccagaaatacgttggactatccaatttacttgatgttttcatactactttgtattgaatctgtacacttttgctccattacaaagctgacagaatttgcctactataaagatgccgtgcagcagcaaagatttgctttggtggccgccgttacctcagctgttggggagtcttccggggtgcctgtcgccatcccggaagagaagatcgaagagatcttcgagccattggggatccaaatccagcaactgcctcgccatgacgtggcggcctctggaactgaaggggaggaggcatccaacacggtggtcaatgtggaagagcaccagttcatctcaaacttcgtcggtatgtcgcccgtgcgcgacgaccaagacgctccgaggagcatcaccaacctgaacaacccctccgaggaagaactcgccatgtcgctccatctgggtgaccgagagcccaagcggctccgttcggactccggatcaagccttgacctggagaaatgaagtgcaaaaagtgctggttctgaatttctgattctggttcttcagagtttattgtcattgtggacagccaaaagtagtagtagatcaaaagacctcatatgcagttcagaaaaattgaacctgcagtaagcttcggtgagcttgaatggctttggcaagcatatcatgtaacatgatgtattattattactacaattgattcagccccttgtaggatgttaggtgctagtcctgcagttttgctgtgctcatgatcgtgagacctgatatacaccattgccggatcccttcctctttgtagaagaagaagaacaatgtgcagggaattatgataatgatgatctttgatctatttccccctattattatttaccaattatcaggtttcaattatcaatcagtctgaaatcttgcatttgcatttgcattttgtcaaccagtctttatcttattaactcgggatgatctgttgcactgtcactgacatgtggggcccctaccccgcgccgcgtcgcgacatacctaaccgtattaaactagatcacctccgagtcttttgttacaaaaggaccagctaccctcagtcaatgactaggtgggaccggaaagtgtgggccactcctgtcagtgacacagaggaagaggcgtaagtacggagccgcgtagccgtcgctcgcttcatccggtttggcgtacggatacgggattgcgaatcccccacgcatccggaaatcggaatcccacccggttcgggaaaaggataaaaccaccccggttcgggaagattcgtccatggctgccctgtcgtccacgcgaccgaagaagcaaggcaagccctagccgccactcccgatttgcttcccagcccttgcggctcctgcgattcgatttggcgggaaattgctcgcgctctcgctcgcgccatcggttcttgaatcggagggattgggagcgggggggaaggtttcttgctttgcagccgaatcttgactggtccagtttcgtgacttacctagtgcccattcttcccgtttgagatttagaagcaagctttggatgaaaagcatcatctttagcttctttgatttgttgggtgaagggggctctcaattctttcgagccattgctgctcattcgagagctatcctttcaccggttggattggaggagctagtccataaatttgtataggaatctgaggaaagggcgctctttacggtgcccatggctgtgctggaggatttgatcagggcgattgagctctggctgcggattgctaaggagcaggtacccttggtggatccaacccttgacccggttctgcttgtccccggcataggcggctcgattcttgaagccgttgatgaggccgggaa

SEQ ID NO: 838 - DNA, 3474 bp, Oryza sativa; identical to SEQ ID NO: 409

SEQ ID NO: 839 - DNA, 11549 bp, Oryza sativa; identical to SEQ ID NO: 413

SEQ ID NO: 840 - DNA, 3417 bp, Oryza sativa
gttgtgttttctggttttgtggataggacaccaggaccttgtcacctcggaaatcatcctcgtcggcttgtgattcttgtcggaaagacaaggtttggacgtactaggatccttctcgggctcggatgtcatcgacgttccgttcttcgcttcggcgggaggatccttcgacatggagtcatcctgggttgtagccactgtgttctcgcttccggtcattgatggaccagccgagatcgacaccgtggtgtaaaccgggaagacgatttcgccgacttgagtccacaccagcattgttgaagtaggaactccttggttgaggttggtgttgacgctgttgtcgacgaagctggatgtcatagtagtagaaccttgagcaccaagtccccctacctggcacgccactgtcgatgggggatacccgtagaccgaatatagagggtattggggtacgctggtatgaggatctacgtaatacgacatcaagcagacagaaaacaaagattatactggttcaggccccttgataggtaatagccctaatccagttgatatgggattatatgatggaaaccacagattacagaaggaaaagcagaactcgatgataccgacgagatcgtagtcgagttgattcgactagatcacccggcgacttggctcctgtaggcttcaactccgtaggctgtggtggatgtgctgactatgagattcaatcacttaggtcctcccggggggtcccttttatatcgcaggtcaactggtctcaaagtaggactcggagacatcggactcggcacgatacaatgacgacccagttctgtccgagtaggactccttccatctgtgaactccatgatgaatttccttaacgtatgccgaaaacgtccgtatacgcgtatgtataccatatcgatgtgtgacgtatatcgaagggtagagggtataccttacccgtaaccctgacaaatattttagattcatcataagaaatatttttatataattcacatggtgttaaagtatatataatggtcaaagatatgtttaagttatgataaagctaaaacgatagttaatttaaaatggagaaagtgcaagtacattctggatgggtagataagaagagcagatggagatgtgtggggtgtaggtgtgatcgatcgagggacgacaaaccaattaattaaccacgctagcccagagtgatcgatagcagaatcgtacgtttgtaatgacgtcatcattatcatcatccacagcctctgctgctgcttgttgcaagagtagaagtcgtaatcctcctccggcgccggcgccacacactagtactgcacgagtagttcgcagcagcaggcggaggcttctcttagtattcttctccgcagaggcggcggcggctgcgacgagcggtctcatccagaccccgtgtgggcaagcctaccctttcgctggcaccaacgtgaagaagccgcagccgccgtccaccccttactcccaatcccaatcgcagcagcagtttggcctcgacgccaaagggtaattaactaaaccggccgccacagatctggatggatcgatcttaaaattaagaaagagattatatatattatggatgcaggaggattagggcgtgcccgtcgacgaaccccggatgcgtgtccacaaaccccacggtgggcgcatcttgctccttggcctccccgctcatcgtccccgctaatacaccaacggacaaggccgccgctgtaagtgtacgcacgcacgcatttgttattcatttaatatagcagtatttgtttctgaattagtaattcgatgtgaatgaatgacagtcgctgcgcgaggctatcctcaagacgcagaggaatgcggtgatcaaagccgacgaggagacggcgtacgggcactacatccaggcggaggtcgacggcggcgcaggccgcgacgtgatggagttcctcctcaaggaatcccagtcccagtcccaggaggtggtggccgcgtaccgatgcgtcgccaccaaggtcatcttcgtctaccccttcaccactgccgtcggcgattcaagagggcagagccagaggatcgccgccgtcgcccaggagctcggatggtacgccccggacctactcaacgccgccaccgccgacgaccactctatcctcgactattaaccaaggccatacatatgcttgcttcattatctctagtctgtacaagtacaactcgtccaaattcattcatccatccatccatccacgacacatatacaaatactaatctattattactactaagtagtactagtagccaccgatatatatacacaacaaatgtattaatcaaaatgctaatttatttctacgccggccggcgtccttgcacttttggatgatattgggccttaattttcatcgtaggtcaccgagttagcccatgcactgtttactgtgtcatgaaataagcatgtgggcctcacaggtatttttaatttttttaactaacaccagctgacagacatgtagggtgcttttgaattttttgtcccatgtaaacatcatatgggaccagggcggatccagaaaaaaaaattgaggggcttaattacacagttttttcaaccttcagccatttagggacctttagtttatcattcatggtgaaaaaaataaaggggtgctctgggggtatccatgggtcttgtgggtgtaggggggactcgagtccccacgcatccacgttggatccgcccctgtatgggactaatatcaactaaacaagccacatatagattaggactatgcttgtatcttcatatctctatttggtttattaggccactttgttccatgtattttatacttccgagacctcacagatcaaaacatggactcatccaaggcccatatgatttcgcctccccatctaattagatgtatagggctagatgtccctcttctttgtagttgtagggccctgtcctgttgacaagaaaatcgaacacatcggcctaggagatctgcttagctccagtgcaggtccaaatatgatgagatgcaggcgtgccagccagtttgatcctacaactgacaagatatgcaaatagtagatcaaattagccgatcggctaacaagccgatggagtagttccagccgatagccgataatagccgatgtcgataccagccgatagcgatagggtttaagcaatcggctatatgtcaaatatagataatgatataaaggcaatcggctgatgatgatgtaatatagcaatataatccagtagaaaccaatcggctaacaatatgatatagtagaacaagtattgatccgaaggttaaagcacccatcggctggaggtctgatgtcatgaaatccacaagattagattaaacaatgaaacctttgttg

SEQ ID NO: 841 - DNA, 6900 bp, Oryza sativa; identical to SEQ ID NO: 374

SEQ ID NO: 842 - DNA, 11549 bp, Oryza sativa; identical to SEQ ID NO: 413

SEQ ID NO: 843 - DNA, 2981 bp, Oryza sativa; identical to SEQ ID NO: 414

SEQ ID NO: 844 - DNA, 7962 bp, Oryza sativa
ctctatgtatttcctacgaacattttcatgtgatccaaatgacgccacagtaaagcaatccataggaacccaaatccttcatttttcctgtgtttctcctctattctgaacaagccctaaagaaattcaaggaggcacctgaacgccggccaattagtgccagcgcaaacagccgatcgctgagaaaatgtgaataaggcaaagcgcgaactctggaaagcgctcgagagaggtcggccggcgacccaacaacacaccaccaccggcctcgcgcccgcggcgcacacaagatcgccacagcgccgtggtcggaacagcgaatccggccgcctgcaggcacaggcggcagtgccacctccccacccccccaatccgctgcgtttccctctggcctcgtcccttcccaacaaacaaacccgccaccacacggcgcccagcgcccgtgctctcctctcctctcctctacccgcccagcccagccgcccatcccccctcctttccgcggtccttttgctcggttcagcacgcacgcgggcacgcggcacgccatcaccgcgcggccggccgcctgctgctgctacagccagtggagtactgttctgggccggccgcgccgcccgaagccaccaccctttccttttccggaagcctccccaatcctccgccattccccgcatagcgccccatgcccctaccgaccatagcctcccaatcccccatcgcctagctgcttcgccgtttattttaagatttttctttgggttgtgagtaaggcttggtggggcccagctcacggttccttctggcataaacaatgacttgggcctgcccgccccgtggcctcgccatccgacactgtgcctctcatcccgcgattagtatatttttgctgtttttttatgggtgaaaaactgtgtgggctctctcgttgggttgctatccgtccacccgtccattcatcctcgcctttgccagttgcggtgttgcccccctcgctttatttatgtcgacctgccaataggagcaagtccccgtctcgagacaccagccgcgccgcgcctcgcctcgcctcgcctcacctcacctcacctcaccctccgcctcgtctccttcccccctttcctctacccacgcacgccctctctcccatcccagccgtagccgcgccgtgacttgtctcgatcggcggcgaggaggagggcttccgttccctggccggtgggggaggatcaggcgggggggcggcggggagggggaggagatcggtctcggtcgatccgcgcgcggcggcgatggcgcgggagaggcgggagataaagaggatagagagcgcggcggcgcggcaggtcaccttctccaagcgccggcgcggcctgttcaagaaggccgaggagctctccgtgctctgcgacgccgacgtcgcgctcatcgtcttctcctccacggggaagctatcccacttcgcaagctccaggtatgctgttctactcccacgcctggatatctctcgactccgcttcgtctcccgcgtttcgatagatctagctaggcgcgtttcctcccccggtctccctttgacttcgatgtctaagatccatccgcctgggctagggtttaacacgggatattttaactagtaacacggatctcaccatttccacccgttcagaaaaatcaatacagttttagaacgactcgtggttactttcgccccctttagatgtaggggatttactgtagtgtatgtagtctgcacctgtacttttgcagattattttcgaggtgttctttttttggtgcatgagtagcccatcttatttggccattcctactggaaatatcgtacgacaactcctgttatttgctgtttatgtgcgcgtggagttaatcgatgtgtgtgtcgcagtagtgctgtgttggtgataaagctagctagctctgctgatagcctacggtcgtacgtgtgattttatgtgctgatgcgtcgcgttttaccctctgatcaatggggggtctcgtgttttgtgcacggaaaacctcgcttcctgttgttgttttcttttgcaatgtgttaaatcattgcagaactgttgtttgatgagaaatatcctgttgttgttttcttttgcaatgtgttaaatcattgcagagctgttgtttgatgagaaatatcctgttgttgttttcttttgcaatgtgttaaatcattgcagagctgttgtttgatgagaaatatggtagtctcctacacgtatcgttcgtcatatccatctcgccttatttgaggacaatgctttcctcattgcaatcccttttctgcgccttaattaggtattatactgttatgctgtatcgctatatgtatttacatcgtgctgttcagtcttgtttgcagctgtacaatatgagtttgtttatgatatactcgccctttaatttgttactcatgataacaaactgaaataatttactcatagatctttatcttgcatgtatccatttcgaaaagtttcctttgtcttaataaaagaaatgttgtactagtacatatctcattatatcttcatgtacctgtccatcacttcatcgtcactatatatatatatatatatatatatatatatatatatatatatatatatatatatatatatatatatatatatatatatatatatatatatacaaacaaacaaaaatggtgttagctagaattctcttttgctgagaaagtatcttaattattatttcaggtttgttaatttgcatcaatttataataccttaacttcttttacttcaaacagggattttgttaaacaattgcaatttgttttatgtaaatttaagtacatcatttttcatttcttcgatgaatgtagattatctcagataagataacctgatacttcctttactcttctacatatgaatttgtttagttcatatcatatataaaagaatggacggagtatgttttttatggttttacatcagttgtcagtagcacaacttaagcaaggattcaacttctcttgatgtacttttttagaaatgtgcacatatacaacttaatttcatccatggtacaatttatttttagttcatttctacaaactagagttaagtgttggaagaagataaagaataaactgggatggctggtactgttatatgtggacaatcattcagccttggtagcatttaaatatgttcattttacctggtagtgagtactggtagaatccataaatcgtgcttctatcaataaaaaatcacactctataatattaattcaattttggagctgcaaggcttggtttatctaagaagttactatttataaactaacatttgtcttgattatttgttctacagctggacaatgtattgatcctttcttctacatttggatgccataatatctgattttcttactgttttctttttcagtgcttaattcctatatttctgtcaatatcaacttacccgtgttaatttgaccagggaaaaccactttcatttctcaagattactcctgcaatgttatagacttgtagtctacttggcccgtgcctttataattatgaacattcatgtataatttatgttctattttcgttttatctgatggtctgtggcctactgtggtattgatgatgccttctgttggacagtatgaatgaaatcatcgacaagtacaacacacattctaataatctggggaaagcagaacagccttcgctcgacttgaatgtatgtgaatcatcttatcatactgtgttaatagtaaatactgttcttcatatatattgcatcttaatgttgcctaactacatatagtagtattagataatggttcaaaatgggtcattttatgtccatggccttagggtggcacaatagcaaaatattcatatttaggttttcacatctggtagcattatgatcttatttctgtaccctaaaattttacaaattaaacttaaaaaaacaatcgcatatgtggatcctttcaaagttctcagtatgctctaatgatgtctgttttgttggttgtgtgttaaatatgtaaattatttgttttaattttttgttgctggattttttttaaaaaaattaatacttgcagaaacaatttacatctctcacttcctcatatttttggtgatacactataaattaacattattaaataatatagttctctatctttttctattgtatcttgagaaaaattccctggaatcggtacactatagcacaatactaattctgttttttcatggatcatgaactcaaatttagtactgttagtagtaattagtgctcaggcatgatgtaataggtgccttaaacttatgcagatatattttctaaatgctacttatgcagatagttaatactaacagttcaatcttttcttttcagttagaacatagcaagtatgcacatttgaatgagcaacttgcggaagctagtctccggcttaggtcagttcttttaaccttttttttttaaaaaaaatgttatacttgaggcatttgttctcagatcctttattcttgaggcatttattctcaaatgtatatcattggtacatgaacaaattgtagacaaatgagaggtgaggagcttgagggattgagcattgatgaactccagcagctagagaagaacctggaagctggtctgcacagggtgatgctgacaaaggtttggtgatcatcacccagactcatcacgtagctcgtactatgaacaacttattgattgctatatgattttgcaggatcaacaatttatggagcagatcagtgaactccagcggaaggtaccacctgttgctagattaaccctgaatcatcaatgtagcttggcaacatataatttgttttttcttgcaaaagtagaacctttaaagaagactgtgttgcatacaagtatccgttgctggcttatttgtagttcattctttccaatacatcactgtgtaaaaagttgatttatagttctctccaatacagagtgaaatcacttataattttactgttgcatcttgcatgactaatatatgctgccaccttctgccttttcttgcaagatggcacatgcatctgttcaagcaaatttactaaatcatcaccaccctggccttttccccatggatgagtcggaattttggactaaattccctgcccaacccttggaagtctgcgggttttgttcatgccggaaaagtccttagcgattaaaaacaatttcttctagtccttattgtttcaattttaccaaattatattggcgttttaagtcatgtcccttcttcccccaaattgaaacattgattttgactatcttgaagatcaaattagagggtacccattggataaaataactaatttaaatggaaattgtactttagtttttctgtcctgcatcatttaccatttgcccatttacatacatttaagtattgtagatgtttcttgctgtgttggaaactgatcaaacagtaccatttcttgggaaatgcaatcttatagttaaaaaaagaatctacaatagattctaccgcatccaaaatgttcttgtgcctgcttgtttttattcaaacccttaccaattgaaataagagaacattataattatgtgttgcatactctctgttgcactgcagagttcacagctggcagaggagaacatgcaactcagaaaccaggtataaattttacttctgtaagctcttggtttgttgaggacttaagaccagtccatctgaacacattcgttttcttggtactgaatacaggtatcccagatatcaccagctgagaagcaagttgttgatactgaaaattttgttaccgaaggacagtcctctgaatctgtgatgactgcattgcattctggaagttcacagtcgcaggataatgatgatggctcggatgtatccctgaaattagggtgagtttctgatcactttgtttatgtgctgaagttaaattccaattcaagtttcaggaatattggtcatatgattatttggtttaatggattttaaggatgtgattggtgactttaatccttagatgtattatcatattatcaacaggcaagataatccatttatattattattaaactttattttgtatacatggatacaaattgtgtgtcgtgtttttctgggtattgtttgagaccgagctatggccttttgctaattcttattttcttataaatccagatatgtgtacctttttttaaaaaagatacatgtatacttaatacacatttgataaatgctttttttttctcttccttaagctatactattttatttcattccgcatgtcctaatacttggcaaatgtagttaagccacatttggttctctaattgcttattttctttttcttaattaagctatactttgtttcatgtcctaatacttgtcaaatgtagttaagccacatttggttctctgattggtttgagaagaaggatggaatttgaattcttgcctgggggtgtactcaactacgtttgattacttgtatttgcccttcagtattttgttcatttcgatttttcttcaactctacaatttgcaggctgccttgtggtgcatggaagtaactgaaaggaaaaaaaaagcatccttgcagatctggttggagtcgttgcggcatccaggggagaaacgcttgtgttattcccaaacccagactgcaataatataatcttgcgttggaagcgagatcagttaacctgatttatcatccttgtggctgcatgatgcgatgttccgcttgtactgttcgctaggatcttgactaaactttgagatctatgtgccgtttaattatcccatcgctattggcactccttatgcgatacatcatatatgcactttgttgctatcttaattatgatgcgtcttttgcagcgttctaagtatgatcttgcgctatcttgcattcttgcgtaatatatatacattgtcgctgtcgttagatttcagttcttagctagcagccactagttggtgttaatagcttttccttttcctttcccttttcttttcatgatttacctgtcacgctatttcgcgggctgcaatttgttgcttgagatatgctctgcatggaagaacactatgcagatgcgctccagcattgattttcattatgggatactaacggggtatatgttgctgtgtgctacagatgtacagcgacgcagcagaaaaggtgacagctgcagtatatgtactgatctttccatttaatattaaaaaatctatatctttccgtttgctcgcatatccttctattttggattaagagcctcaccgtttgacttatctgcggaataagctaaataatatgtgttcttagcgatgtaaaagcaaaggctaaaaaaattaatgtcgatgaaaaaaccttaaaatcggcttcaaatttaaggttaaaaatttagattttggttaataagtataagcataagtgaaaagataagaccgtaaatggttggatttcagttgccagatttattcatcagctagagaattaatccatatttggttcactgtagcatcgcctttgttcatctcattggtataagaaaataagtttaatctgtatatataacaattgcatattaaaattgtctttagaaacgttttttccaatattgattttttttactatcatatcttgatctaataaaacagatcaaaatagcatctcaaatattgtaaaaataacatgcccaaaggaaagttactacctccatcctcgttctcaaaaggacgatgtaacatgtgcaatcaaaccatgatttaaaatgtgaaacttatattgctaacttcgtcctaaaatatagtaatttctaactatataatatttatatatggataagtgtttgttgggatacataaccagtaaatatatatttt

SEQ ID NO: 845 - DNA, 3474 bp, Oryza sativa; identical to SEQ ID NO: 409

SEQ ID NO: 846 - DNA, 5839 bp, Oryza sativa
ctgaaactgtttgtctgacctccacctccaagctggagctgtgccaaacaggcccttagatccaaacttctaacttttttcatcacatcaacctgccatacacacacaacttttcaatcatatcatatcaatttcaatccaaacttccaactttggaaggaactaaacacagccatatccccgttccaattatagatcggtttgattttttttctagttaattttttaaaattcaatcaaatttatagaaaaatctaacgatatttttaacacaaaacaaacataatatgacaaaaatattcaatgttacgtatgatgaaactaaatttgtgttgtagatattgctaatcttttcaataaacctgatcaaatttctttgaaaggtttgactaagaaaaaagtcaaagtaacttacatttgaaaacttgcatttactttggtttgatctgttcatctaactatttgcaaaaacatttccacatccaaaaaaagtgttactccctccgtctcatattattagtcattttaaattttttttctaatcattttttatgtttgattaaatatgtagaaaaatatagtaatttttttaacacaaaaccaatatttcatcaaagtatatttaatgttgaatttgatgaaaataatttgatgttatatatgctgctaatttttttctctaaacctaattaaagttaaaatagtttgattaagaaacaaaaattatactacctccatattttaatgtatgacgccattgactttttatttaacgtttgactattcgtcttattcaaaaaatttatataattattatttattttattgtgacttgattcgtcatcaaatgttcattgatcatgacataaattttttcatatttacacaaaaattttgaataaaacgaatggtcaaatattggtcgaaaaatcaacggcgtcgtacgttaaaaatggtgagagtaatatatatgaaacggagggatactttcactagagctaccgcgccacccgctcacaacggcacagtgtcacgcgcgcgcgccagtccgggtgcgccacccaagtcaaccaccgcccgctctctctcccccttcaaaacgcccccacccaaagccaccgcacctcgccaccaccgccccaagaatagcacccgcgtttcatgcgctgatcgaccgatcgacccaccagctaagccacccgcagccgcggggcgagccaagcccaccgccgcagccgcagccacagccatgtactcggcgaaccactggggcgggtcgttcgagatcgccgcggacggcgcggcggaggatgaccacagccgcaacatggacctggaccgcggcgcgctgtcggcgcggcagcaccagctggacgagacgcagcagagctggctgctcggcccgccggaggccaagaagaaggacaagtacgtcgacctcggctgcgtcgtcgtcaagcgcaagctcctctggtgggtcctctggaccctcctcgccgccttcatcctcatcggcctccccgtcatcatcgccaagtccatccccaagaagaagccccacgcccctccccccgaccagtacaccgacgccctccacaaggccctcctcttcttcaacgcccagaaatgtcagtcccccctccatcctgtgatatgatcctctgtttgtgcgttagttaattaactaactaggatggaaacctttgccaaaacaagaatcttttgactttgatcagtagagatctcatcgcatttgccatttgtgttagagcttctgaatctgcagacggatttgctcaaaatgagtagaagtatgttgccttgaatttccttaggtttactgagttttgaacttttgacccgtgatattagctgcatgattatgtgttgatcccgaggagagaggatcgagcaagtacaaatctacaggcgagtagtagcactagttagttttaatcagttcagttgagctgtgcacaactgcaaccccacaaatggaatgttctgtgctactgttcatagtcccacagctttgaagaaagtgacactctgatgtggagagaaatctcccaaaaatccagctgcgctttggcttggagtcttggcaatttggcgtctcacgcacgttcgtgcacatgtaggacagccaattgatccattctttaacgcggcacgaagtactcctctgcaatactagtgtacctgtagatctcgccgcatgatctgcttctggatcttgacagatactctgcacttgtagatcttgagcttacactacagtactactagtcatccgattctgacttccatgctcaaaattcagtttgaaacgtgcactgatgaatgcagcccttctttctctgacgaacaattttggccatgtctcgttctctgctctgacagccggccggctcccgaagaacaacggcatcaaatggcgcggcaactccggcctgtcggatggctccgatctgacggacgtcaagggcgggctcgtcggcggctactacgacgccggcgacaacatcaagttccatttccccttggccttctccatgacaatgctcagctggtcagtgatcgagtacagcgccaagtacaaggcggtaggggagtatgaccatgtgagggagctcatcaagtggggcaccgactacctgctcctcaccttcaactcctctgcttccaccattgacaaagtctatagccaggtacttgctcaaagtcccaattctgaatatatttcattatgaatcttggaagaaatatttgatctgtgaaaattttggtgcattgttactatcttggttcttttctgctgtaatcatagctggaagaccgtagaatttataaatgcagagaagcatactgtttcttactacagcagtaaagtaagtttctgaaataaggtcgtagtgagcaaactggtcagttctgtcaattacagtattacatgccgagcaatctattccatcagtaattgattggcacgcctaacaacctttgactcttatcacatgggctccagtagaataaggttcatcatccaatcatctgcatgtgctgaacaataatataattaaaacttaggagtggtcgatctgtctcgatctctcagaactacattttggcatacaatgaaagatgcagtggtaaaactttgattcacattctcttactctgggttgatccaccaggaaaattatgtaaaaacatttgaagttatcagtattaagtgaaaaagaaaatgatgtcaaatcaagcatactaggtctgaacggtgcatgcatgctcctgcaggtgggcattgcgaagatcaacggcacccagccggacgaccactactgctggaaccggccggaggacatggcgtacccacgccccgtccagacggccggctcggcgccggacctcggcggcgagatggcggcggcgctcgcggcggcctccatcgtgttccgcgacaacgccgcctactccaagaagctcgtgaacggcgcggccgccgtgtacaagttcgcgcgcagcagcggccgccgcaccccgtactcccgcggcaaccagtacatcgagtactactacaactccaccagctactgggacgagtacatgtggagcgcggcgtggatgtactacgccacggggaacaacacctacatcaccttcgccaccgacccgcggctgcccaagaacgccaaggccttctacagcatcctcgacttctccgtcttcagctgggacaacaagctgccgggcgccgagctgctgctgtcgcggctccgcatgttcctcaacccgggttacccctacgaggagtcgctcatcgggtaccacaacaccaccagcatgaacatgtgcacctacttcccgcgcttcggcgccttcaacttcaccaagggtgggctcgcgcagttcaaccacgggaagggccagccgctgcagtacaccgtcgccaactccttcctcgccgcgctctacgccgactacatggagtccgtcaacgtccccggctggtactgcggcccctacttcatgaccgtcgacgatctccgctccttcgccaggtctcaggtacgtgtaatcgacgatcgatcacagattttcacaatgcatgcatcaattggaagttgttttgctgacgacggcgatgtacatgtgcaggtgaactacattcttggggataacccgaagaagatgagctacgtggtggggtacggcaagaagtacccgcggcggctgcaccacaggggggcgtcgacgccgcacaacggcatcaagtactcgtgcaccggcgggtacaagtggagggacaccaagggggccgacccgaacgtgctcgtcggcgccatggtcggcgggccggacaagaacgaccagttcaaggacgcgcgcctcacctacgcgcagaacgagccgacgttggtgggcaacgccggcctcgtggccgccctcgtcgccctcaccaacagcggccgcggcgcgggcgtcaccgccgtcgacaagaacaccatgttctccgccgtgccgcccatgttcccggccacgccgccgccgccgtccaagtggaagccgtgagagagaattcaatccaaccggccggccaagtacatcgccgtgcctagtggttccgaaggtgtttgattagatcaacgaggtgtttcggttcgtttggtcatacagtttttggtgatcacgcaattcttttgtattatacacgttaacttcggcaaaatcgatactgtggatgatggaatgctttatgcatgacctgtagatgaaagatgttttcttcatataaattatgatcacggtggatgaatcaacagatgtgattacaaataggctgcaaacaagttgcaacaaaatgggattcaaatcagtatgatctcttacaattgcgtgactatcttccgacgagaagaactgccacttggcacttggcagactgtcgaagggatcatacgagaggccagaacttggtatgggcggtgcaaagcatatcaagagattattgccttagtttcttttccttttaaagcgcaaaccgctaaccttgtatatagaaccttttgttttctcctcctatgaatataatgccggcacccagctggatcttccaaaaaaaaaaggaattgctaaccttacgaaaaattcatctttaaatcttataggttttagactattggatgagcttcacgattcgtgctctaggcctttttctccaactctgacaccaacgacaccctatactttgacaaaggaccttacgggttagggtcccggattgaaggtgggggtggaagtgggagttcatcaactttaaagggatggttgtggtaggcggcagcccagcggtggcgacggatcgagcgagcagcgaggcagtggcgaagctgccgcctaagccgtagggtcaaaagttggcggtaggtcggtgtaggcgacgggggctgagcggaagggccgttaggaggaggtggagacggggaagatggtggcgcagggacaactcgctgccatcggcttaaggaaagaagagtagagagagggggaaggggacggacaggggcctcgctggtgccgttgacatctttcggccagccgaccaggcgggcggcggcgtggcgagggataagagggcgcgtggggaacgagaggaggagaggagctagggttaagggggttctgcacgaatcttaaaagcatatccagcattccaaaattacatgactgcacgaatctcagtttttttatgtttttaaaccgagttctactcaaatttcaaacatatatgttctagtcaaggcaatatagccgctgacgaggccactgccagccg

SEQ ID NO: 847 - DNA, 4230 bp, Oryza sativa; identical to SEQ ID NO: 741

SEQ ID NO: 848 - DNA, 6414 bp, Oryza sativa
ttcgctttgggcaaattggacctagtttttcctctctctgtgtgtagaatgaggagagatcgagaggtgtctcggctttcatcaagcggtatattcatcatcatttcgtccatcttctagctgacttatactccatccgttttgaaatatttgacaccattgacttgttagcacatgtttgtccgttcgtcttattcaaaaacttttgtgaaatatgaaaaattatatgcctacatagaaatatatttaacaataaatcaaatgataggaaaagaattaataattacttaaattttttaataagacgaacggtcaaatatgtgctaaaaaatcaacggtgtcaaatatttcgaaacggagggagtatacgctaatagaagcactagagtgtataagtggaggcattagtagctcaagtggtatcgtcttaataatagaaaaacagagtagtcgtttgtttttaagttgtttttttttcttaaattcctcctgatctcgttcggaacttggaaatatcacttcacaagtgacagtttgatttcctcttgtgtttatgcattattttgtgaccgactaagggcgttttcaatattctcattttctaacttatactttctaatttttcaacttatactttctctttttttcacgtgtatattttctaaaccactaaacagattttctttaaagtttatgcagaaaagtttcttaaaaaattatattaatctaatttttggctaataactaaataatcttcgctaattaatcactttgttttacgagtgataaaatggttttcaaccctcgacaccaaacacagcctaacatgtgctactagtacgtgaaaaaaatatgaattttcagaattcccagaacacacgtttgttgtctcgagaaatgaataattaataaatacatgggacaaaaatataatcatgctagcaactaaataaaaaagaggaaataaaaacaaattcaaccccagagagagagagggagaggaaaaatggggtgcccatgcggccctgcccaatagcgttgctgtacctttcagctttataatctcgcccctcgcgagagagactccccccatcctgcagactcgccccactctcttgctcagctcctcttcatccagtcctcaaaactctctctgatctctctctcttgctgaaaattctccgcacactccggtgggcttaagcggtggcggcgtctcgcctgggtgggcgagatccctctcttgctcgtccgcaaggtcgctccccctgcgagtccaatctactgacgagctgggaggagcaaaggagggggcaattggagctccgctcggttccaattcagccccaattttgagccccccggctgcggggttcggccaggttagctcctgttcttgcggaattctggctctttttttttttggggtggagaggggatgatctgggtggggtggggagtggtggaattctggtttttttttttttgttctttctttggctggttttgttccgtggggattgaattctcggttctcgtcacctcaggagtggtgttcgcgctgcttgttttggttgatctgtgaattatgggggaagacaccaccttttctctcgtttcttgcacttaaaaatcgtctttggtgagctgttgtgcttggggagctcttgagctgagcaggttcggtttaatctttgattgggttctatacttcactgtttcggtgttcccctctgccgaatttgggaatcaagaggttctgatccatcagtatcactcggcttctcgtcattgcatatgtacaaaacctgcttttttcaatcactcatgtagtcatgtctaattggtttgtcttttatcatcttttggtgtaacttgtctgtgtcactaaccatgccataatttttttttcatgggtactatgtgatcgatttcttcttcttcttcttcttcttcttttttaaatttttacctgtcataattcaagtagtagcagtagtaatctaatctaaagcttccaaattttccggtgtagttgagacgccatgtatcgggtgaagagcgagagcgactgcgatatgatccatcaggagcagatggactcgccggtggccgacgacggcagcagcggggggtcgccgcaccgcggcggcgggcccccgctgaagaaggggccatggacgtcggcggaggacgccatcctggtggactacgtgaagaagcacggcgaggggaactggaacgcggtgcagaagaacaccgggctgttccggtgcggcaagagctgccgcctccggtgggcgaaccacctgaggcccaacctcaagaagggggccttcaccgccgaggaggagaggctcatcatccagctccactccaagatggggaacaagtgggctcggatggccgctcatgtaagtcccgtcccccccccccggtgtttgatcccatttgctgtacgtatttgttcatactaagcagttgagagattgctgttcttactcctaaagatttcccctgagtcatggtcagttaaaagcttattataggtttacttgatcttttgcctaatctgatgatatgcgcagttcttcatccaccacctaacttgatgtttccagggagaattggtgtgctattagatcattttaattttagttccaagttgtagaattcgtttgtagtgattggttgattgcctttcttgaaggatacttttatgggtttttatcaagtgaagtattttgtttcacggattagaattgtattaaacattattttccttggtgttacttgtatgctctaaaacattaacttatatttttctagtgcaaggcagaaagttatcaagcttttggtttagaaattaggtttggtgatttttaaaaggactctcatgtagtacagtagcaacctgcatgaagccctactgctttcaatttccaaaattgatttacaattcttaaggttctaagcttagatctaagcataccgttcacttttacatgattcttctgtagctttatcttctcaagttcatctttgtcggttttactcctgcatggatgcggtcatgatcatatgggaagatgggcttaggtattcttcatgtgagtagcaaagaatacaaatagtgttcatcaccagctttgttgttactgagagcaagttgtgctacgtcgaaggttgaaaattgtttggtgcagttgtttgccttaaatctgttcattttggattgttcactgtgttagaaggggttgggaacaagcctagctaaattgtccgttgtctaggactctaaacagcatagttacaattcacaaggtaacataattgatatctatttcagtctgaccaagtagtgctattattcttcgcaagcttagagtaaccatctaaggcctttcaatcttgttaactttcatgattcacagaatcgaattaattttttgtcataatagtgtgaacttactgagtttctatgatttcttgaactgatcaaacttgtccacgtaatgatgtgagtgaaaattaggctgttgtctgccgaattatttcatatgtatcctgtgtatctaagtctttagagtaagcttatcatttatcctgaactctttgcacatattttctgtattttttcctctttacttacattgagcacatcttctcagttgccagggcgcactgataatgaaataaagaattactggaatactcgaataaagagatgccagcgagctggcctacccatctatcctaccagcgtatgcaatcaatcctcaaatgaagatcagcagtgctccagtgattttgactgtggcgagaatttgtcaaacgatcttctgaatgcaaatggtctttacctaccagattttacctgtgacaatttcattgctaattcagaggctttaccttatgcaccacatctttcagccgtttctataagcaatctccttggccagagctttgcatcaaaaagctgtagcttcatggatcaggtaaaccagacagggatgctaaaacagtctgatggtgtgcttcctggattgagcgataccatcaacggtgtgatttcctcggtggatcaattctcaaatgactctgagaagctcaagcaggctgtgggttttgactatctccatgaagccaactctaccagcaagattattgcacctttcgggggtgcacttaatggcagccatgcctttttaaatggcaatttctctgcttctaggcccacaagtggtcctttgaagatggagctcccttcactccaagatactgaatctgatccaaacagctggctcaagtacactgtagctcctgcgttgcagcctactgagttagttgatccctacctgcagtctccagcagcaaccccttcagtgaaatcagagtgcgcgtcgccaaggaatagtggccttttggaagagttgattcatgaagctcagaccctaagatccgggaagaaccaacagacatctgtgataagttctagttcttctgtcggtacgccatgtaatactacggttcttagcccagagtttgatatgtgtcaggaatactgggaagaacaacatcctggtccattcctcaatgactgtgctcctttcagtggcaattcattcactgaatccacccctcctgttagcgctgcatcgcctgacatctttcagctctccaaagtttccccaggttggactctgaaattcctcatccctctttgatgtgattattcggttatttatgatgtactgttttgcagcacaaagcacttcaatgggatctggagagcaagtaatggggcctaaatatgaacctggggacacttcacctcatcctgaaaacttcaggccagatgcattgttttctgggaatacagctgatccatcagttttcaacaatgccatagcaatgcttctgggcaatgacttgagtatcgattgcagacctgttcttggcgacggtatcatgttcaattcttcctcgtggagcaacatgccacacgcctgtgaaatgtcagaattcaaatgaattctgtatttggtatttgccagacgctacagcagattcttggtatcgttcttgctcattgtttggatcataacttgaggaagatctcgtcggttgtaattctgcattgctgacagagtccttgatggcatgcaggcactatcagatgttctcttatgcgactagcccttttgtccaataaagtagtgcatggagataagccggttaattattgttttcttttttgtattagagaaccctttttgtcatctctattgcccgaattctgttggaaattcgtcatgtttgtttgaacaatgtaagaccaattattgcatttgtggtgtactatcttgttgagcatttaccacttgccaatcaatagcaatttgttactactacacaccctgtcacattttctttttctgcagcctgcaaacctggtactcaaagccatagctgtcttggagataaacatactttgcagtgcactgatgcattatcatatttaggattgtccatggaaagcagcaatgctgtgccctccagttttggcttttggaatctgcttgctttagctgtggtggctgaagagaaaaggggccataagcctcggagatgaatgattagagctgacatatggtttcatagttggaacccaacacaagctatcatgtatgacatgatcaagaagttgcgacgttacacaattcgcaaaacgatatacctaatttcctttggtgttcttgtgctgtttttgttctttttgtttcataataccagtttcctttctttttctctctctctgtaccgcagatgtgttgaacattcagagctgtggcattctggtacttttttttttcagagggtggcattctggtacttattgttattattatcatttcacaggaagtacttgatccttttctcaaacatcacatccaatccttttatagctactgatagttttcgacttctctccctgccaacttgcaatttgtcaaaaaatggtttcttctctcagacctcctttgaaacaatggaacggagtattttatttttattttgagaaattgcattgattcttagaataatcctataaaattattgcatttcaaaggaaccatcagcatatagttctattctatacactttcttcatcccaaagtagataaaaataatatgagatgtgatacattttaatactacgaatcttaaataaatgtgtcacattttatattagatttgtttagtttagaatgaaaggagcaagatacaagctgcttttctggctcaaagcagggagaaaaaaaaacagagagcagaagtatatgtatactagttatatcagcacacatgtatgcgtgcgacgcgtgaccaccgagaagatagcaactcacg

SEQ ID NO: 849 - DNA, 7990 bp, Oryza sativa; identical to SEQ ID NO: 431

SEQ ID NO: 850 - DNA, 4679 bp, Oryza sativa
ttttgacatcgtacctttccaaaacgacgagtattattaattcggagggagtattagagcaagtttaatagtatagccaactactggctccaaatcatttatagtcaatttaatagccaattcatacaatagttacctataaacatatactgcaccagtaatatctggtctcacttgtcatacacacttttgcgtcttgtagtctgtgctgcagctgtctacaaatctgtagcccgttgctcttaggccagtcccaaccaaagatactagacacagtttccataaactccacatcatgaaaaaactagtatagaaactactctttcaatgtaaacaccactattccatacttaaatttaattgtacttatctcacatgataccttcgatgttgtgtagaaactatctctcatgcaaaacctggttttcttctctttcctcatttattcacctgtcacaccatctttcatcataggtggcagcttatttaatgctatggacaccatccttgtcattgggttaggactggccttatcactgctcacttatcttttactcgatatgtgtttacatctggcttatagtatgctatttaacctactcttagtccaactacaagcaatatttaaaacttgatgcaatccatgaaacacgaagtgatgtagcatcttaaccgttgagaattaattatagaatgataaatgttttaggacctgtttagttcctccaaatggcaaaagttttactgttttggtgcactttttgccaaaatggatctaaacactagtaggaaaagttggcaatttggtatttatcatttgggactctagaggagcaaattttggcaaaaaatcgttgggagcagtgcgggacgcgcactacccctgctgcccacgtgctctctctctcccccaaaatttccccatctccactcctctcgcgaccaccaaccagcggcttcccgacggtggcggcgcacgtgggcgaggctgagggctagggcgcgaggcaatgcagatggcggtggcggcgagcaccgaggccctggcggttgcggccgcggcgacggcgagggcgcctcagcaccaccacatcccatcgcagccgaggtgggtggtcatcctgtactcgccgctgcacggtatggtggccgccgcgccgccacctcccccaccgcagttcgtcaagcacttcgcgccgccggcaccggtcaccccgccgccgcatccacaaccgcagcagcagcaggcgacgggcggccgggggtggatccggcggcgggaacagggacgagaaccgaacgagggctacgacgatttgggcgccgacgatgaggagcagcagcaggcagcggcggccgggggtggccccagcggcgaggtccggtctcttctccccagcttgctcccccgatccaacggcgagatccggcgaggtagcagcatttaatatgggcaaatcagtctttagtaaaatggccaaactttaccatgcatctaaataccaactagcaaaacttcaatgccaaatcttttgccaccaaaacatttgccaaaaaatttgccatagcaaattgatctaaacatgcccttattattcttggtcaccacgcttttttacttagataatgattaaaatgggatggaaggagtaataaagcatgtgggaatgattgcataaagattgtgattgattgaaaaaagaaaatatgtgaaagagaatggttgtaattggttgaaagggaaagatagatgaaaaatagcttcattttataacaaattgttttgctaaaaataactatattttagatgaagttagtagtagaaacgaaacaaccattccgttcagtgtgcgcgcatattttctcatcaagattcagattttacctcaaacttccattagcatgttttttaaattattaaatagtaatatatatatatatatatatatagggatgggtgggggcaaacgtgtctgtacaccaagttgtggcatagtagcacatgtagccaccatccatctctttagctttggaccaactaaagatgccgcaattatgcagccggtagtccagtcccgtccccactccacaccctaccaccgtgttgcacgatccgtccatcaatgcgtatcgatgcgatcgttcgtgcacgcacgcacgcatgttgtcctcgtgccaaatgccatggccggtgcgcccagagacgagagaaaaaacaacgacctcaagacatgcagttcgtcccagtcccacctaaccaaagggccgaaccctggttaaataatggccagccagcgcagtgctgcgccaccgcaccgcaccaccaccgctgcggcatcaccaatcggcaatcgcagagcaaaagcatcgggaggagcaagctactagtagtagtatagtagtactagtcaaagaaatcaacagcttgattgaccatggccgccgccgccccctcgcgagtctccgtcagggccgcggcgcccgggcaaacggggggcttcgccaagatccggccgcaggtggtggtggcagcggcggcgaggtcggccggggtgagcggccgcagggcgaggagcgttcgggcgtcgctgttctcgccgaagccggcgacgcccaaggacgcgaggccggccaaggtgcaggagatgttcgtgtacgagatcaacgagcgcgaccgcgagagccccgcctacctccgcctcagcgccaagcagacggagaacgccctcggcgatctcgtccccttcaccaacaaggttcgctacctagtagtcccctagcttcttcttcatcctccgctcggtcgcggctgtgctgagagccgttcccctgcttggcctctggttcttgcagctgtacagcggaagcctggacaagcggctggggatctcggcggggatctgcatcctgatccagcacgtgccggagcgcaacggcgaccgctacgaggccatctacagcttctacttcggcgactacggccacatctccgtgcagggcccgtacctgacctacgaggagtcctacctcgccgtcaccggcggctccggcgtcttcgaaggcgcctacggccaggtcaagctcaaccagatcgtcttccccttcaagatcttctacaccttctacctcaagggcatccccgacctgccgcgggagctgctctgcacgcccgtcccgccgtccccgaccgtcgagccaacgccagccgccaaggccaccgagccccacgcctgcctcaacaacttcaccaactagctcaacccgcgctgtacatcacttccaagttccaattgctactgttactactctgccaataattgatggagatgcagatcgagctgcctgattagtttagtgttaattgcggcatgtgcggtgtgtatcgtatcactgataaggaagaggaatcgaggacaagatatttgtttcctccctgcgatgagccgatgaactgatccgaacaagaagaggcttcttggtagtaggtggattggaatatcgaaatgatatgattgtgatccgcaactacaacgaccgccactacggagagctcatgctatttgtttgtttgtttttgtactagtgctcaaatatatactccagctcatgtccatgtgtatgttttgctgctattatttttttctcctgaaaataaaatatataacaacgcgcattggcatgatgtgaattggaaaccaccttaggaccgacggtcacgcagatgctcaatgttagacgtcgttcaggcacttgacatgtgggacctatcttaggacatgctcaatgttattgtagaaacataaatgtcatttggatttttgattaggagccgactagttcagggtagtaaagtcaaagagttctctggtttacaattttgtacccgaaaaatgcaaaatgctatacacactagcaaacattcgactcccacatgattggggtggcaatttccctgttagagatcgatcccctctggggacccgcctcaacaaggatgggggcgcgttgaaattctcacccgtggggctacgggaacggtcccgatattatgcgaggctagggtcggggtgagaatctcctttgtcggtgacctgtggggctgaaatatgatatatggcccattagatttaagcccatatatcccactggacggaagtatctatggaatagcaaaccctatccaatctcgtaaagcagtcgccacccatctcatttgttttcccgtatgcttagcgacgcgacccctaaattgcgcaacacaatgcacaatgcatcctctccccatagctccatcatgactagcgagtttgcggcttgcgcccgcaccatgccgtgacgttggtcgacgctctctgacacacattacttttttctcatccatccctccgtccggacgaagcaccactctgtctgcaccatcgctctcggccataggagaccgcgatgtctcccccatcccaccggccacaggtgcttcgtggcatccccttcctctccggctgcctcccacattatcttttctcttccttcggttgcaggttgctaagttcacatgtttttctctccctatggccaccagcaccaggtgcgcggggccctagaggggccgggggtggggatcgaattcaccccaatccttgctccgaggtggggccgggtgaacccacgatctagtgggg

SEQ ID NO: 851 - DNA, 4218 bp, Oryza sativa; identical to SEQ ID NO: 653

SEQ ID NO: 852 - DNA, 4013 bp, Oryza sativa
gtgaagggacttatgattagcccctccaaacaaacaacccgaagggagtactgttacatagtgattgacacatgaactgttgacagatggaactgtcagtacacgttggatccatgctttagacgtctcgacaataactttggatttggatatactagggaaacaacgagggaatacaatcttcgaattctagccttcgaccaagtcacccgcgcgcatgtaccttggacgacgatgttgtccacttgccgtgcgaacgtgtggaggtaaagcgaaaaaagactaggtaaaaccatgcaagcagcacacgcgtgcttatttactgtttagttacatggacggatgcaccaaataatttcagctagacagcaatcattccacacgttctcctctcctgctccagctccccatcccagatgaggtggcaacaacactgcttaaacacgccaccatctcggccgccgtccggccggccgtcttcgcgagtgacgcagctcccatcagcagcaacgagctctgctagctttcgtctcagcgctccgtcctgcggtcttttgggtctcgaatcgcctcatgtggaccccacaatcacgttggcaaatagcagctgccctggtgctgcttctcacgttttagagcaagtttaatagtggccactgctagctccaattcatcaatagccaataaaataattgcttactatactattaatatatggtctcatctgtcatacatatattatgtcttagagtccgcgctgcagctggttacagatctatagcctgctgctcttctctctcatcttttatctcattaaaatatgtttacaggctattagcctgctattgtacctgctcttagagagagtgtgtcgtgggtgactattcagtctcccctctcatttctctgccacctcatcacttttgccatcgtggacacactatcaccaggctccagctaatttttttcaattgtacgtgctcttagtcgacgtacgtccaatttctttctccaagaaagaacgccgaacaagcgccgacgaaaaacggttcctcgttatttctctccaacgcgcgcgcacgggctatttctacccccgccgccgagtagttaggcgtccaaagtttcgggagttcatcgtgaacggtgatcgatccaaagaacaacaactcggagcaaagctagctaacgaagttagttccaaacaaagctagcttatcgcgattagctagctagaagagagttagctaggcgccatggagctaggcgtgccactgccacgacggcccgtgcccggtagctacggcgtgccgttcgtctcggcggtgcgcgaccgcctcgatttctactacttgcaggggcaggacaagtacttcgagtcgcgcgccgagaggtacggctccaccgtcgtccgcatcaacgtcccgcctggcccattcatggcgcgcgacccccgcgtggtggcgctcctcgacgccaagagcttccccgtcctcttcgacgtcgccaaggtcgagaagcgggacgtgttcaccggcacgttcatgccgtccacctccctcaccggcggctaccgcgtctgcgcctacctcgacccgtccgagcccaaccacgccaagatcaagcagctgctcctctccctcctggtctctcgcaaggacgccttcgtcccggtcttccgctccaacttcggcgcgctcctcgacaccgtcgagtcgcagctcgcgagcggcggcggcaagtccgacttcaccgccctcaacgatgccacctccttcgagttcatcggcgaggcgtacttcggcgtgcgtccctccgcgtcgagctccctcggcaccggcgggccgaccaaggccgccctgtggctcctatggcagctcgccccgctcaccacgctcggcctgcccatgatcatcgaggatccgctcctccacacgctgccgctgccacccttcctcatcagctccgactacaaggcgctgtacgcgtacttcgccgccgcggcgtcgcaggcgctcgacgccgccgagggccttggcctgtcgcgggaggaggcctgccacaacctgctgttcgcgacggtgttcaacagctacggcggcttcaagctgctgctcccgcagatcctgtcgcgcgtcgcgcaggccggcgagaagctccacgagaggctcgccgcggagatacggagcgcggtggccgacgccggcggcaacgtgacgctggccgctctggagaagatggagctgaccaggtcggtggtgtgggaggcgctgcggctggacccgccggtcaggttccagtacgggcgcgccaaggccgacctggagatcgagagccacgacgcgtcgttcgcgatcaagaagggggagatgctgttcggctaccagccgtgcgccaccagggacccgcgggtgttcggcgccacggcgagggagttcgtcggcgaccggttcgtcggcgaggaggggaggaagctgctgcaatacgtgtactggtcgaatgggcgagagacggagaaccctagcgttgacaacaagcagtgccccggcaagaacctggtggtgctcgtcggaaggctgttgctcgtcgagctcttcctccggtacgacaccttcaccgccgaggccggcaaaaaggtggtcatcaccggggtcaccaaagcttcaacctccgccgtcaatcgtactgcttaagccggccatcacttcaggcgtgggtcgtcgatcatccactcaaccagctccgtcctacgcatatgcaataagaaatactcgtacctgaattcttgcatggctaaacactactaataagtgtatgtattctgtttatttgttcgattccatatttgtaattttgttgttattgtttgctgttgaattacgattgtgtattttacagggctgacagtgtctttaaacacctctaatatgtatcggatcaatctgccctagtcatgtctaatttgtgaagatccactttctttaattattcaatcatgcatttttttttcttctttgtcgtcgtccttcccccacgtacatagcacttcatatctcttagaataaaacaagtaatctttacctgttgttccaatattattactccctctgtgtttttaaatatatgacgatgttgatttttgacagcgatgttaaatcatttgtcttaattaaaaaaatataaatacttttttattttattgtgacttattttatcatcaaaagaagctatatgtaattttaacttatgcttttacatatttatattaatttttaaataagacgaatggtaaacattataacaagtcaacggcatcataaataaaaaaacagaggtagtatattgtaagttgttttgaattttccctaactcagatttatttatgtttgtccaagtttttttaaaaataaaacaacatttttaaaacagaataaatatggtataaaaatatgatctatactgaatataacgaaactaattcgataatgctcaaaatcgaccctccccccgggcacgtgcatgccaggcccgccacatgtcgcacgccgctcccatcacttgtccccactatgcgcgccattgtaacaaatcacccgtatattaagggaattcgtttcaatttttattccaccaaaaatgtttcacctaatatgtcgacgggggatacctgtagaccggatatagagggtattgtggtccgttagtacgaggatctacgtagtacgatatcaagcaaacaaaagacaaggattatactggttcaggcctcttggtaggtaatagccctaatccagttgatatgggattatatgatggaaaccacagattacaaagggaatagcagaactcgatggtaccgacgagaccgtagtcgagttggttcaactagatctcccagcgacttggctcctgtaggctccgacttcgtagctgtgatggatgtattggcggtgagattcgatgccttatgtcctgcccagggggtcccttttataccgcgggtcagttgatct

SEQ ID NO: 853 - DNA, 8944 bp, Oryza sativa; identical to SEQ ID NO: 651

SEQ ID NO: 854 - DNA, 4160 bp, Oryza sativa; identical to SEQ ID NO: 638

SEQ ID NO: 855 - DNA, 7827 bp, Oryza sativa
cgacgcgcgcatccaagtggtggtggtcgagctagcttgttggcggatgcgaacgtgagagaggcgggccgctcttgtctgcacagatgcatgcacgcgacgcgcacggcgtgttgttgccatgggggaggaggattgggtggttacggggaggattgcgcggtgacgcagcgcatccacaaatatacgtgcaatatatatttaagttctatttttataaggattttactactctacgttatttgttaatgtgcttagtcaatagacagcgtagagataaagataagtgagcatacgttatgttccttatgacgctaccaacacacctagatctaagattcaaatcctaaatttaatacgggtgtttgcacttatgagtaattattcttttaaataataggtgacgtcccgtcgacaacgtaagcatacgagtctgtactctattcctaaaaataaaagtagacaacgtaaagaaaattatttaagtggtagatgtactactcgatatgtttgtccaatttataaagtgatcatagtagtaatatgtgcatgtgtgcatatatacgtgtgttttttttaaagataatggacacgtgtgtttttgaacgttcataatagtgttttgggaaaataattagataataaaacgaagtttgttgagaaaacgagtgaattaaccaatgccttaatttggtactgcaagtactacattgggataacaaattagagatcgacgaaaagcggaatatcctttttatttgcgccctgacggatatctttcagtttgtaaccaccggatgacgcacggacggctcggatcatcccgaaaagatcaaccgcggcgcgagcacgagaccaccgtgggccccatggcccaccgacttacacaatctctcccactgccatgcgggcccacacccgcaacagtccagtccagagagccccgaactcctccaaacccgggggggccacaccctgccacgtgtcacccgccgcgcctccctctcatcctctctctcctcgtccagtgcttctccttctcctcctcgcaaccgaacgcctagaagcgcgcgtccaccaagccacggactcctctaattctctctcttgctttctctctcctcgcttcccgggtttgatacgtggtacgtgacgctttgcccttttcctctctctctctctctctctcttgatcagtttgatttgatcggttccgccattagcaaacctcgccgattctctctctcgatcgaacaggggtagggaagcgattaaccggcgatcgatcgatcgatgcaagtgatcgcgctcggttgatccaggaattggagagcatcggctgatcgagagatggcggggaacgagtggatcaatggctacctggaggcgatactggacagcggcggcgcggcggggggaggtggaggcggcggaggaggtggtggtggaggtggaggtggcggtggaggtggagggggagggggagtcgacccgaggtcgccggcggcgggggcggcgagcccgcgtggcccgcacatgaacttcaatccgacgcactacttcgtggaggaggtggtgaagggcgtcgacgagagcgacctccaccggacgtggatcaaggtcgtcgccacccgcaacgcccgcgagcggagcacccgcctcgagaacatgtgctggcgcatctggcacctcgcgagaaagaagaagcaggcatgcatcgatctctccctgtctttttctttctttctcgtgttcatggttgatttaatttagtttctcgtgctctctgcatgactgaattaattatctccgagatacttctgaactttctattcgacagaaaattcagattttgattttaaaagaaaatcttgtcggaactatgttatacggagtgctttaactattcatcaacacgataccatataatatcctttacaaggattcagataatttttagtggtaacgatagatcggctaaattgtcgtgtagggctagatcaggccgttggcatgattcttttctgctttcaagaaaagatcagagtgttcaattaatttcagatatgattatagtcccttgtagatcatgtagtttgtattatgcaccacacacgtttgtggaaagaagaaagtatggcaacccaacggtgtcagtaatggacgatgagtgtgctatcttttttccttttccaagagtaggaaacaggatctttttaaaaccactcaattggccatgccaaaagtgagtttattgtgttcttttcgatgagaaaaaaaattatgactgttcatgatgctcctaaaaggtatttgtttctgagattgcctaaatttttatgtgagcagctggagcttgagggaatcctgaggatttctgcacggaggaaggagcaggagcaggtgcgccgcgagacttcggaggaccttgcagaggatctgtttgaaggcgagaaggcggacaccgtcggtgaattggcacagcaagacactcccatgaagaagaagttccagaggaacttctcagagctcaccgtcagctggtccgacgagaacaaggagaaaaagctgtacattgtgctcatcaggtcttataccgcttactttactcattggtgccattctgtatatgccactaaattgcaaaattttactgagttcctttattctttgttctactttagtcttcatggtctagttcgtggcgataacatggaacttggtcgggattcagatactggaggacaggtaaaacatgattgatcttttcttttcttttgagcagatatttcttatcatctccagccctagttcaaaaaaaaaaaattcttatcacccagccctgcatggttgcgtattactgtttttcatgtcttgcaggtgaaatatgttgttgaactcgcaagagcacttgcaatgatgcctggcgtgtacagagtggatctgtttactcgtcaagtgtcatctcctgaagtggactggagctatggggagcctactgaaatgttaacctccggttccactgacggagagggaagcggtgagagtgctggtgcgtacattgtgcgcattccgtgcggtccaagggacaagtacctccgtaaagaggccctgtggccttacctccaagagtttgtcgacggagctctcgcgcatatcctgaacatgtccaaggctctgggggaacaggttagcaatgggaagctggtcttgccatatgtaatccatggccactatgccgatgctggagatgtcgctgctcttctttctggtgcgctgaatgtgccgatggttctcaccggtcattcacttgggaggaacaagctggagcagatcatgaagcaagggcgcatgtcgaaggaggagattgactcaacttacaagatcatgaggcgcattgagggtgaggagctggccttggatgcagcggagcttgtcataacgagtacaaggcaggagattgatgagcaatggggactgtatgatggctttgatgtcaagctagagaaagttttgagggctcgtgcgaggcgcggagttagctgccacggccgttttatgcctagaatggtggtaagtgttcaataataagcgtaatagtactgtatcatatctgacaaatttccacagatcttgtgtttgacttgaaacttgtggtaatcaattttgttttgtatgtgtgatttatgtttttggtaattattatgcacactcctccacaggtaattcctcctgggatggatttcagcagtgttgtggttcctgaagataccagcgatggagatgatggcaaagactttgagattgcctcgccgaggtcactgcccccaatctgggctgaggttggtttctggatttcctcttcaaatgtataattgttcccttcaaatggatttcaaatgctgatgaaattgtttattataggtgatgcggtttttgaccaatccccacaagccaatgattctggctctgtcaagacctgatccaaagaagaacatcaccacccttgtcaaagcatttggagaatgtcgcccactgagggaacttgcaaacctagtaagcaacagttacttgaataactacatttccttttttttattcgcaaggaagaataactgcattttcagcactttaccagtacaatactagtaaatagtaatattagattatagttgcaccccaaaagctaatccatctgtcatgaacacaaagtacaaaaaatatttcaagtagtatgtacaattgcatactacttgcaaatatttcaagtcacaaaagtagtatatacaatgcttctgaacattcttgtacaattgcataattcatgtattactagtacctagcaataaaatttgccttttgttgcagattctgatcatggggaacagggatgacatcgatgagatgtccgctggcaatgcaagcgtcctcaccactgtcctgaagctgatcgacaagtatgatctgtacggaagtgttgcattccccaagcatcacaagcagtcagacgtaccggagatttatcgcctcacagggaagatgaaggtctgtcaccagtcatgtcctcactctgtttcagcttagccatgtccccactctgtttcatcttctgtaacttgtaactaaccaaaaacatccgctctccttttgcagggcgtcttcatcaatcctgctcttgttgagcctttcggtctcaccctgatcgaggtcttctcatagttcaattctctgacaaccacctgattattattctttcatgtacagcttaactgacaaactcatggcatttatttaggctgcggctcacggtctcccgatcgtcgccaccaagaacggcggtccggttgacattaaaaatgtaagcatccatcctcgccaaatcttgtgtacaaccgcaatatttgtgcaaagaattcatatccgtgtgcgtattcatggtgtttgcaggctctgaacaatggactgctggtagacccgcatgaccagcacgccattgccgacgcgctgctgaagctggtggcggacaagaacctgtggcaggagtgccggaagaacggcctgcgcaacatccagctctactcgtggccggagcattgccggacatacctcaccaggatagccggatgccggatcaggaacccgcgctggctgatggacacgccggcggacgcggccgccgaggaggaggaagccctggaggactcgctcatggacgtccaggacctctcgctgcgcctgtccatcgacggcgagcgggggtcatccatgaacgacgcgccatcgtcggacccgcaggactcggtgcagaggatcatgaacaagatcaagcggtcgtctcccgcggacacggacggcgccaagattccggccgaagcggccgccaccgccacctccggtgccatgaacaagtacccgctcctccgccgacgccgcaggctgttcgtcatagccgtggactgctacggcgacgatggcagcgccagcaagaggatgctgcaggtgatccaggaggtgttcagggctgtccggtcggactcccagatgtccaggatctccgggttcgcgctgtcgacggcgatgccgctgccggagacgctcaagcttctgcagctgggcaagatcccaccgaccgacttcgacgcgctcatctgcggcagcggcagcgaggtgtactaccccagcacggcgcagtgtgtggacgccggggggaggctgcgccccgaccaggactacctgctgcacatcaaccaccggtggtctcacgacggcgccaagcagaccattgccaagctcgcgcacgacggatccggcaccaatgtcgaaccggacgtggagtcctgcaacccccactgtgtctccttcttcatcaaagaccccaataaggtccgtacagcgccctgcattctacttaatcacaatctcctgacacattgaaaaatgttctaatttgttggtatctgaaattctgaatctgaattctgcttcattttttaggtgaggacgatcgatgagatgcgggagagggtgaggatgcgtggcctccgatgccatctcatgtactgcaggaatgcaacaaggcttcaagttgttcctcttctagcatcgaggtcacaagcactcaggtgaagtctacatacaagttttacacactgtagtgtgattactgtagcatttacggcaacagatggtcttattggcaatttctcgtaaattcaggtatcttttcgtacgctggggcctgtctgtgggaaacatgtatctgatcgtcggggagcacggcgacaccgatcacgaggagatgctgtcagggttacacaagacggtgatcatccgcggcgtcaccgagaagggctcggagcagctggtgaggagctcagggagttaccagagggaagatgttgtcccatccgagagccccttgattgctttcacaaagggtgatctgaaggccgatgagatcatgcgtgctctcaaggaggtcaccaaggctgccagtggcatgtaaattggttgcctgctgggaagcctaatattactctgaagcctggaagaatcaggagtgccagcttgatgaagtctcctggctctttaactgaaagacaagactctttttctctccttaatttacagcataatcttatggaccactaccacgaacttaccttgcagtgagaaataattatgacactgctgatgctactgttggctcaaatgtttatgagctgattcagttatatgtattttttcttttaatcctgcacttggttcaagtacgcatatcatggcaattctcttaataatttcggtccttgttcaggattggattacttggcacgttctctccgtggtttgtgaaaataacctaggacataaatgttttgtaacttaagtttcagtaaacccagtcaaaaggaaacatacaattcaaacaagctgactgataattaacactgtatttctgacactaggttcattttctgagactgtcctatcgctgaaaccttttttttattttttgaaagaactgaaactttaccaagctaactaatactctctccgtccctaaatatttgacgccgttgactttttagcacatgtttgaccgtttgtcttattcaaaaacttttgtgaaatatataaaactatatgtatacataaaaatatatttaagaatgaatcaaatgataggaaaagaattaataattacttaaatttttttgaataagacgaacggtcaaacatatttaaaaaagtcaacggcgtcgaatatttagggagcataaatgaaggttaagttatatttctttaataataacttacaggccacgtggcacactccaattggtcgacaaacaaacgcaaaactggaatgataagggaaaaataatctgctactagtatttatcttgcctacacaacttccagcatgatgctttctgaaacgtccctgaagcatttacataggcaattgattggttcaatatctgcttccctctgcgagacatgtctcttccctaatcaatatcagaacgaaactgccacaattttacaatatatacagggattggcagaggccattgtgcaagactgcttattggttccaatcaagagtgtatactaacatggaagaaaaggaggaaatgaccatgctttcccttggagttggagctgctagcaagcactcaatatccaacagaaaattcagactgaaagaagtgacagatcacaaattcaaccttggagatcaagatcataacagtggccatgtgaggaagaagctaaggcttagcgaagaacaattgactgtgctggaaaatatgtatgaag

SEQ ID NO: 856 - DNA, 8287 bp, Oryza sativa
aagcacgatcgctcgcatcgcgcgcacgggaggcattcgcacggctgatttacctgaaacacacgtactccactcctctgcgatttggctgccgcgcgcgcccgccttgagagatcgatttccagcgagttagtagttaccgtcgacgacgacgacgaggttgatcgagttactacctgttgttaccgtgcggagatatttccggacggtgacaacgaaaatatcctcggttttgctcacgctccatctgggacagcgaggggttggtttgggggaggcagagagaggagggcgaccccaaaaagctaaagcaaagcgacgacgaggaggacgccgacgaggcggcccgctgcggccacgtggcgcgtggcgccggcggggatgaggttgcttcaacgtgtggccacctcgtctttgtgcttgcgccttccccgcaacctagatctttttttgtcctcacccagtcactcgtccgaacacttgtctaatcctcttgccaaactaaaattaaaacgtgcagcatgatagtaaaattaacgctgtcgtgccaataatttcttgacgacaacgacatactacctccattttttaaatagataacaccgttagactttttctcacatgtttgaccattcgtcttattcaaaacatttacgtaattataatttattttgttatgagttgttttatcactcatagtactttaagtgtgatttatatcttatacatttgcataaaatttttaaataagacgaatggtcaaatatgtgagaaaaaaatcaacggcttcatctattaaaaaatggagggagtataatgttgaaattagaggtagataaattttgggaacgaaattaggaatgacttatatctcaaatcataattatggttcagtttaacccgatggatttggacctgaacgtaatttcgaaacttcccaagggtatttcaccaagccgtacgcattatttaaccgatggtgaagtggtgagcacacgccctctcctaaaaccaaggaacccaaccccacaaaaaagcgtaggacgccggagtgcgaaatccttatccgctcgcggcgacgccatggccgccgccgcggtggtccacctctccgtgcacggccgcctccgccgctcgccggagctccacgcccggccataccaccgcccgtcgctgctccggtgccgcgcgttcaagcaggaggccgataacggcggggaggaggcttcgtcgtcgccgccgccgccgacgacggccgaggcgcggaggcgcaggaagggcccgctgtacaagctgaaggcggcgattcaggggctcgccgggtcgcggtcggcggccgcggaggcgtacgggggcgagtaccagcgcgccgtcgagaaggccgaggagatcttcttctcggtgagctccattcctgaaccccctcaagctcccccgcaagcgcagtttctctacatgataatatgataatatgtttatggccgattttttcatctgatcgtgtgatctactagtacgactgcctttaattgttgccacgtatcgggaggctcaaccactcaatgcgttagcgagcgctactaccttaatcagctcttgcttagctgcatatgggaattgcacccatcagatgctacagctacaagtgagtttaggcgatctatgttgtttcaatgggtgttaggatccaatacactagctgtggcacaaatcgatgagctgatcaacactaatcagcttgtttcttactagtaatacagtaggctccagttactgtgaaattctgtaatgtcagttccctttatgtttatgtgctggagagcaaattctgcctgcgctaaaattaatcgcaggcctgtgaagcaatttgcctgggcagaggatgcggctcgtagccagaggtgtcattttgtgtagcctttgttgcttttgaaactattttaaacttctttgaaactcgctcttgattaaatttacttcgcccctcatttatatgggcctagattctctggttcttgcatctaccattgtatggggggcatgggctgccaggctcatggttttacatgtccgactgtaagtgcatgcacaggcctgctttatagttcaattgaattgcttcctaggcatgctgattctttgtattgatataaataaaatctccggtatcggctgattctctaacctaagcacatcagtaattttctatttgttgcaaacctgaacagagtggttctgaatttatcactactgagttgtaggatcaactccttttctgaaataggtgttctttttttcaaattgacttatttccttctccttttcaggttgctacgcaagtaggccgatatgttatcactatgatgagcagcggtgttgtacttggagttggatttcagttatcaggttagttacattcatttgatatattgcattgcctttggatacttctgtttttttccctacaatgggcattttcagagtttcagtaatgacctagctacctttctatttaggcggagacagccaaatgaatacactaatttggtatagttggctcgggggagtaattattggcacgatgataggtgcaaacagtgtcctagaggaacactgcaaagctggacctcgcaatgttgtcataactggaaggtaacccattttgcattcttcctttcacatgccatctgaatcttttgctaggaagcatgcatactgtgagtacaggtcaaaggtaataatcaaaactaatgaatttattcctagataggaaatactatttcaccttctattattctctattttcttatttgatgagtggagtataaccataacaatcaccaagtttatacgggttggtgcatagaggagattatgaggtgcagtcatatgaacaaatcattaaagtaacctcataaacatgttaatataaacatgacttctcattgcatcaattgtgagctgatttcttattagtatccatgttctgcaatcaacattgaagttatagtttgattttggcagcacaagaggattagggaaagcacttgctcgggagttccttctttctggagatcgtgttgtaattgcttcacgcaggtggtactcatagacatgtagctcaatgtgtgttgttgttgcatatccatgatattctttttatgaaatgcaatgcgttgtcctagttttaaatatcctattttttgaaggcagccctgaatcagtccttcagaccatcaacgagcttgaagagaacatacaggagggcttgtcagttgcgaaaaagaaacagagagaaattttgctacatgccaaggttgttggtacatcatgtgatgtttgtaaaccagaagatgtgaaaaagttggtgaactttgccaaggatgagcttggatcaattgatatttgggtaaataatttacttttacatatctatccccatcatttattctgcattatttcacggtagggtactcagttggatacttggattgagtgcacaagtttttgtacttataacctttttattttgttctgtactgtggcatcgcagaatgtacttaacatgtgctattcttcttattcttatgtatagataaataacgctggcacaaacaaaggttttaggccactggtaaacttttcagatgaagatatttctcaggtacgttaattatcttcggaaaatcagagtcttttccattctaatagagttcatagaactatattcgtcatgcaacctgacttagttatttcatcttatttttctttctgcttagcctaaacaacattattgtgtccttttctgtttgcagattgtctcaacaaacctagttggctctttactgtgcaccagagaagccatgaatgtcatgcaacaccaacaaaagggaggtcacgtatttaacatggatggagcaggttctggaggatcaagtacaccattaacagctgtgtaagtacctaatgatttcaaatttttaatgctccactgttcgtgtagctcttatactggacagggatattgtcttgtggtttcttcattggctaaaaacgagtataattgtattgatgttgttacttgtgcagtgaaactaaaactgatactattttgcaaacttgcagttatggttcaactaagtgtggccttagacagtttcaagcatcacttctgaaggaaagcagaagatcaaaagttggtgtacacactgcttctcctggaatggtccttacggacctccttttgaggtaacctctgaagttatttagatgcaattattgatgatttgcttgtttagttcattctgaacttcaatatatttattgcttggtgcacatgttgtccaaactccaaaccacactttgtgtgatgatagtaaaacaagataagacttcaagtgcataagaagttttcagtaggatctttatggaaccacacatattggttaatcagaatttcacgctatcttcattttgaatttattttagttaatcaacaatcagaatgtctcctttgttgaatggggaagagtcaaaattttgagatacctcgctgcccaaatcttctttgtttcaatctcttctttctaggatttgatttgtggcaactatttctgtagaatcagcttcacattaattattaagttgcttttgctactacacttctagctctggcttttcctatctgctataatcccgatgacacggtaaactgggtgcgtggcggttaatcagaacctgaaagaattaatgttccattcttgtgcaaatactctgccttgtaaatccagttcaaagttgtgatgttgcacatactttatacttgtaaggcttcatagtttctgtcaatatataaataacttgtgagataacttccagatataattattacaaatgactaatgcactggaaagttctaacatattaatattttttattggtaatactatatacggagaataatatgttttttaacttcaattgatggtgcatgccacttcttccatatttatctggtcagctcttctgttgccacatgcccaactatgcagactgctttagttaacttataatccttctatcttttgcagcggttcttctctgagaaataaacagatgttcaatttaatatgtgagcttccagaaacagttgcaaggacattggttccgaggatgcgagttgtgaaaggaagtggaaaggcgataaactacttgacaccaccaaggatcttgcttgccttggttactgcatgggttcgccgaggccgatggtttgatgaagaggtatgtttcttctctatgcagctagtacttttcagctttaccttttatttcagcaatgccagtatatgaaatatgctgaattcctgcagaagccatgcgtgcaaacatgattgttgttttcattattatgcatcttgcatgcacttttcatgatattgaacctcaagacttttgagctattatgcttctgaaatagtgaaatatacatttctagagaaagagtaccaagctcttctaccgttgcaccaaatgtatatgaaactcattgttgaatataaagaacaatggacatagactattcaaattatgcctgtggtgattttcttgtaaattatgctaaataagcagtattcgttctaagactggatcaaccaggcgagtcagatcataatgaagcttgagaccagtgtccagttctgtcaggtctctacataagtaagagccataaatagggtctgtcttgatggttcagtttccaggttcattatgaccagctcagtccatcacctttactgctagttggccagagctcttctggaaggccttaggctggtcctcccctcaatggcggcttcaaacacctggttccaccatggcttagctcggtccaacagtctcagtgctattgtttgtactgcatgttaaatatgacatagttaattctcacatgtattgctggatctcacctagtccacatgaaatccagcaacagatttaactggagagaatgataggggttttaaaaagcaactgcacccgtcaaatgattgcactctagtaatattttggggctgaaatgggcacaagtatacatattgacgttttttttggtatctcactggtttattggctgtgattttgggaaagaaaatcacctgcaaattttggtaccgtcgaagcttctcaccattagattgacaattattaatggaaaaactgaatgaacacatgtattattttcgcaagatatttaggaaacatgacatttgagaaaaaaaaatgctgagaagtgggtaataatttaattataacgtttgtgttccttcagaatctttcacaatataactgaagaaaagtgctgtatacatcagtgtcttttgtgatggacaatgctccaatcatcctatgtgcaaggttgaaaatcaaacagatgaagtaaaagaatattatattcttacaaatgagagatcagcataccaagcgactttatgcatacttcacagttcataatactttcagtctgatgattaattcatgtgaatgtgtgactgatcataagcacattgcagggaagagcagtatatgcagcagaggctgatagaatccgtaattgggctgaaagtcgagcacgcttctctttcacagatgccatggagatgtacacagaaaacacatgggtttctgtgttctcgctctctgtcgtctgcgcattcataattctttccagctcaggtggacctcttccaggcacatgatcccaggagttgccaaactagatggctacacacaccatttttcttcagtacggggattctattatgtactgatatatgacacacgaaacttatgaaggggggaaattgaacccagaaagcttactgcgtacatacgcccaacggtgagaagcatcagctgccactcaccatttaaggtcaagctaaccatgtgctcagtaaaaatgggtaaatagcatttgttgtgtgggcattccactgtttgtaagctgacttgtaaaaacgtgtatctgagctaaactgagcacgaacagattcgatggacaatgttatctgctgtacatgcatgtagtaatgtagttttgatgactgtaattctctggtcgtcgcttccagttgcacggttgcaccgtatgttgcaaccaccaatagaactgaaagtaagtgagagtaatcaagccagcatctgctatgtatatatatgactcatcagtctgttatatatcacaaggaaagcttcttcaaagctaaaagcaaagctatcagtaagacagtaatcctgtgtttttgtccatttgaattcttgatcacaacaggggagattcagaagttgcattaaggtatactactactatcatttatgcagtttgttgcacctgcagccttgcagagtgatgattcttcttgatggggaagcaggacgttcacttcacctcgtacaaacaatgtacggatttctgtgtgcgagccattgtgagcaaggggctttcttttcttccaaaagtaaaatacaggctagtgcttttttcatgaaaaatatctgatggtgagtggagagtgcacacgctgatgagcagccgagccggagcatgcgttggcaacttttctgaactacaagctggagacgacgtgaggcttctttccgagagttgatagcagcgtgcacttccgaagttgggtgtcgatttctccctttttttctgctgagcaatggcaccttccattagttggagggtggaagcttccttcttgagtccgaggccccaatgtcaccaatcctgtctcttctgcattgttcgttgggagtataagacaatttaggggcggagctaaaacgaaatagagagatgtaccattcacttgctttactctactttaaatcaagtttaagctaatatgagtatttgagtttggattaaggaggtacatatatagtaaaaatagaaaaactatagctaaaaaaattttcttggccaggtttctgggcacccctctctcctacctagctctgcccctaagtgcattgcccgttcttctctactagtcaagttttaggttgaactttttttttaggggatagttttaggttgaactgatctatccatatatgccctttaattttccatcagcttaagcactggggttaaaataaaatatgcatgcaaactttgccttactaacacgcatttacttgcaattgcttagctgattgaaatctcactaaatctgctgctactttgattggattaaccaactacagacaagttgac

SEQ ID NO: 857 - DNA, 32732 bp, Oryza sativa
aatctatattagcgcacggagaagtacgttcaaagcttgtgaaaatatcattttgtgcactaggattttccagcggcatcatctagtagtagtgtagtgctcattaatcaggacacacacaacatatttcatgtagtatatctgcccaaatacctaacttatttactcttaatttattggtccttttctttcatctcttgtatcttgtagagtgtgcgtcttatatgagggtagctcatctcttccatattattatgaaaattttctttcgtctcttgtatcttgtagagtgtgcgtcttatacaagggtagctcatctcctccatattattatgaaaatctacatgacactctttaaaaataacttcaaggcgacaaggccttattagaattgagacaaagacgatagaattcattgctctcgaagcaagttttttttttttaacttcccatatgtaccaatctccttctagtaaccttttttgtttttaaaaagaaaattgtgaagagcattgaccatataagaagtaattatacaataaaaacttaatatatacaccaatctcctttatagtaactactagtaaccttgtttttattgtgatttgtttcatggaaccgcatgagtactttaattatgacttacatatttttatatgcacattaaactttattctagcacgaatggttaaacgtcaccatccaaaacgaaacaacgtcctatattaataaaaacagagcaatcatttatgtatattcttctattagcataaagaaagaaaacaaaatagtactaacaatattccctaagctcttgtagtagatgccatttcgggacgtgtcaaattgttctaaaaaagaaagaaaaaagaacgtgtcaaaacacctcctttttgtcgggataacgaaaaaaaaagattaatggcagttttttttttttaaaaaaaaacgaatctcgttctatatatggcttagtctcgcatcgcaaccgcgcgacgcgagttgtcgcttttcctccccaactccacgatcgagtgaagcggacgagggcgacggcggcgagcgcgcgcacagcgtgtgatccatggaggcgttcgtgccgggcggcgcgggggcggcggcggcggcggtcggagggttcgtcgccgcggccgcgctagccgagagggccggcgtgatcgcgccaaggaaacgccccaacgcgcccccaggtcagccgccccccccccccccatctctcaatctctctctcactcactcactgtcactgtttgatggaatgccgccttggtgagtggtggggattggcacttaccatcggtggagaggggtgagattcgcatcgcaccgggaatcaacaggaagtggcctcgccgccatctcatccatcgcggtcgcgccaggccccgccgacgaggtccgggccgcacggcgctcgccggaccacggcttggtgctgcccacgggcgcacccccccagccggcgcagatggagccgctcggcgctcgtcgtcgcacgcgtgctccacctcgccgtctccgccatcgccggcacccactcacacgctccctcgccgggagagatcggggagaagagaagaatagaaagggggattagggtttacctcagccgccggcgatttctccggcacgggggagatcctggccgtccaacagatcggacggtcgacctcgctcccgcgttggcccgctgtgctaatgggcccacccgatttcatgggccttccgcttccgcaccacctgggccgcgccgccgcagctcttagcccgcgcgcacatgcggcacgaacgcctcttgccccatttccaccgccctctcccgcttccggcgatgtccacgccgaacagcctcacgacacgtgctgcttcgctgcttgtaattggcttctcgtcgccggtggccgccgccgtgttgttcttctagcagtcgatgaagagcagctcgtcggcgcagaggcccttctccctcacgaatcggctccatcccttggtcagcacgtagctctggctgctgttcctggacgagtcacaggtggagaaacctttgtattccggttcgtaacaccaatcgggactaaagttaggatctttagtttgtactcccggcggggtcggggcagcagcggtggcggcagttggagggtttgtcgctgcggccgcgctcgccgagagggccggcgtgatcgcgccaaggaaacgctccaacgcgcccccaggtcagccgcccccccaccaatctctgcatctctctcactcacccgctgtcactgtttgatggaatgccgcctcggtgagtggcgcgcgatcggcgaattggtggagagaggtgagattcgcatcgcaccggtgagtttctgaggaattggagatgtgtgttgctgcttgaaatcaaaaactctgatctcttgattccctttgaagatttgagagccaatcaagtttgcattcgccacaattttcgcaccgttctccgtcactgtctcttctcactctctgtctcttgatctctccattgatatcactcggagacggaggcggagacggagacagcggttgatgccactgctcgcgtaggaacatcttgaattttctcccctcctttttgatctccctttgatggaaacagaagcttttgtcctgcctttaggcagagacgatcagaagaatctatcctctcctttgctttacattgcctttttttccttttcttcatgttattctttttttctattcaagtagaacgatatacctcgtggtgatcatggtagagaccgaaaatgtaaagcatttccattatctgcgaacagaatgatgggatgtttagtattttctcaaacaaacataggcattgcactgacaggattgaattctaaataaaggaataaataaaagatgggccaaattgtttcgagaatcactggaccacactttgaattgtttggatgaaatttacccgtatgtttgcaaccgctacatgttaggcccagtaacctctattaagggaattcgtttcatttttttccacaaaaaatgtttcacctagtatattcacaatgtttcactatgtataaatctaatgttttaataaattgaaacatttttttgcaacaaatcacccacatatttagaaaccctctattaagggaattcgtttctttttttgttccaccaaaaatatttcaactagtgtatttataatgtttcactatgtatagatcaaatgttacagtgaactgaaacattctttcgttgttgaaacattgtttttatataaagtgaaacaacgtctagtttaaacgattgaaacattttcgatctacttattgaaacaattctgatatacttggtggaacatcgtgcaacatttaaaaataattcaataataagctaaatttttttttgtcagaatatatccatatatggtcttgttttaaagatttaattgcaacgaatttaatggtgcaatcgaatcatgatttaatttggataaataatttaagagaaaaaatagtttaaagtggttttgcacgcatgcgtcatgctgatgtcagcgcccgatttttcccctccctaatcggacgcccgatgcgtaggctcctccattcttttcttagattaaagaaagaaaacaaaatagtactataacaatattccctaagctcttgtagttagatgctattttagaacatgttaaaacacgtcgttttcatcatcgggataacaaaaaaataaataaattaattaatggccgtatttttttttaaaaaaaacgaatctcgttctttatatggcctagtctcgtatggatggacgtgcaaccgcgcgacgcgagttgtcgcttctcctccccaactccacgatcgagtgaagtgggcgacggcggcgagcgcgcacgcagcgtgtgatccatggaggcgttcgtgccgggtggcgcgggggcggcggcgccggcggtggcggcggtcggagggttcgttgccgcggccgcgctcgccgagagggccggcgtgatcgcgccacggaaacgcaccaacgcgcccccaggtcagccgccccccatctctctcactaactcgctgtaattgtttgatggaatgccgcctcggtgagtggcgcgcgattggcgaatgactcactcacgattggtggagacaggtgagattcgcatcgcaccggtgaattttccgacgaattggagagttgtgtttctactacttgaaatcaaaacctctgatctcttgattcccttgaagatttgagagccaatcaagtttgcattcgccacaattttcgcaccattctccgccgctgtctcttctcactctctctctctcttgatctctccattgatatcactcggagacgaagacggagacagcggttgatgccgctgctcgcgtcggaacatcttgaattttctcccctccttttgatctccctttgttggaaacggaagcttttgtcctgcctttaggcagagacgatcagaagaatctatcctctcctttgctttacattgcctttttttttccttttcttcaagttattctttttttttcttctattcaagtagaacgatatacctcgtggtgatcatgtcagagaccgaaaatgtaaagcatttccgttatctgcgaagagaatgaatgaattttctgcactaacaggattgaattctaaataaaggaataaataaaagataggtcaaattgtttcaagaatcgctggatcacactttgaattgtttggatgaaatttaccaaaaagcaagttgctcttcagagggcatgcattcatgcccttcaatagggcgtagcaaggaattagaggtcctggtgcgaaaggtataatgggacctcaacatatgattacatctagttctaatcgatttagctttagatattaagccctgttgtgccttctacttttagttttgggtcttaggttctctgaccgtctgggctttagcattttagttatgctgctaattaagtactccctctgtccctaaaaaatcaacatagtaccagatgtgtcacatcgtattactataaatctggacatagatctatcatattcgtagtactatgatgtatcataccggtactatgttgattttttatgtgacggaagaagtatatacttagcacttcatgtaattaagatttggggctgaacaatcgcacacctcactatgttactgtacggcctgttctccaaacagacagccctttctctctcgctattaccaaaatttcagacgatttttttatatttggaatttcgaatattttttcatgaatttgatcccccctcctcccgtaaattcaaacaaatttaaaatttttatgccagaggcatttcctgcttactggtaccttcaaattaaccggtgctggattacagatagaggatgagccgaggggtttggcggtagcttgcttgtttgcagataataattttatttaaacatataaatttgtatgaagcataaagcggaacgcctttcttaccagtgacttactgtagccttccgtttatttttggctgggagcgtgatttttcagttgcaactgtagaaattgatttttcaattgcagtagcttttcccaaagctatcctcatcggaccacttggatagcagtttttttggtaattattgttctcttgatttttttctctagcacattagttcttctgattaacgtagtgtggatttgaaaattaggaaactatcatagagtgaaacattctaagtaaagaatttaatgatatcacatagagactagctttttgtatagtatgtcataaccttaacaaactttagaaaactttcattaatccataaaaagcttccaaatttgttcctctgttttataaagatttcgtgctgtgttagcttgcgcttattgccccatgatgatggaaggacatacatctgttttccattaacagccaataaattcacataactcgcgttattactttgcaaacataactgaaatgacattccctaaatttgtcgattgtttttcaatcttccttttgatatatcaaaattttaaaaaagtaaatatagtataagtagacaaaagactcccactttcactggagacacatggtacatcatgtgttcgtggaacaacatcgacaatatgtacttaaccaaacccaatcggcatgtctatgcgaatggcagaatgtgtatggacagcaccaagagtccaaggcagaaaaaaaaggagagtaaatggcataataaataaagaaaaacctgatgacccatagaaacgaacaggagaattttgaaaatattcagatcagcgctattcattttgattttttataagtcaaacttctttaggttcaatcaaattgaaataaagaaactatgaaaatatgttcaatgtagataaactaatttagttctataagtattgctatattttttttataaacttgatcaaactttcaagaagtttgatttaaagaaaaagtcaaaacaatttataatatgaaacagatggagtgtatatattttgttgacccacttgtgagttgagagtgcaaagtattaattattgtggtctatagtcacctaattctattcgaccatcatcatgtcaatatctgacaaaatctgacaacatcaccgaagaaagggacaacactaattcatcactaggctagttacttgcatgaatatatggtgttatcatctatgcaaacaaattatcagaataactcatttcaagtttttagtctagtgtgcaagttctaagtctcctatgattctatgattctatttcattgtcatgcagctgttcctggtttacccattatcggaaatctgcatcaactgaaagaaaagaagcctcatcagacctttgcaaaatgggctgaaatttacgggccaatctacactataagaaccggggcttcttctgtagttgtgctcaattcaactgaagtagccaaggaggtaacttggaagttgtctatcatttttattgacttgcatagctcaagaatgatagtctcaagaaaccatggatttactgtactctcttttgcaggcgatggttgcaaaattctcatccatatctacccgaaagctatccaaagcactgacagtgcttactcgtgataaatccatggttgctaccagcgactattgtgatttccacaaaatggtgaagcgttatgtcatgtcaagcatgttgggtacttctgcacaggtatacttctcaacaatttcatttttcatttttagtactgattattctcaataactccagtgtgcattttcagattttattatctgctaccagttacactttcagagtttcagtatctgtggtctgacaacgcaaatgcttccataaatttcagaaacaatttcgtgacataagagatatgatgatccataacatgttaagcacttttcataaactggtgaaagatgacccacatgctcctctgatattcagagatgttttcaaggatgagctattccggttgtccatgatccaggtttggattgtctctctgaacttgaactgtcagatggtcgatttgttatttctggcactaacaattaatgtcgcaaacttcagagcttaggagaggatgtgagttcagtctatgtggatgaatttgggagggacatttcgaaggaagaaatctacaatgctactgtgaccgacatgatgatgtgcgcaattgaggtcgactggagagatttcttcccctacctcagctgggttccaaacaagagcttcgaaacaagagtgtttactacagaaactagacgaactgcggtgatgcgcgccttgatcaagcagcagaaggaaaggattgtgcgtggagaggtgaggaaaggcatactttgacaaatgacatctttcatatttgcttctatgccaaaaaaaaaaaaaaacttgcagagatcatcttttaactccatgaaactgagatatatgtgcaggcaaagacatgctatctggacttcttgctggcagagaacacactgacagatgagcaactgatgatgctagtgtgggaggcactcatagaggctgcagatactaccttggtcaccacagaatgggccatgtatgagcttgccaagaaccctgacaaacaggcaagaaatattgttactctgttccagctcattgttggcattcttggcattatcaaccaaagctttttatttttggccttcttcttgttgtcatgccaggaacggctttaccaagagatccgggaggtgtgcggcgacgagacggtcaccgaggagcacctcccacggctgccgtacctcaacgccgtcttccacgagacgctgcgccgccactcccctgtcccgctcatacctccgaggttcgtccacgaggacaccaagctcgctggctacgacgtccccgccggcaccgaggtaagcacaaccactcgggccgaaactttcgtgttttcggtacttgttttgcacgaaattatttgagtttttaaccgaatttgtataaaattttgaccaaattcacaaaactttggaaaattctgaaaattttgggcgttatttttaagataattgatagaaatctgacctctatatccacagtggaccataagaaaacaagctttgaataaaaataacacaagattaagctacacttttcttctatatccttgtttcaaacctgccttggcacatcccgttgaaatccaatactccctctgtcctaaaatatagaagcctagaatcggatatgacatttcctctatcctaatactaggaaattttctatcatgtgctaggttcttatatttttggacggagtattttttatcatatcaggcaaacttgtcgttcttgacttctcgtagagttttcgggtgggatataattgcttgcctggggagtccaaaattttaatcactggtcaactcgccgatcagtgatcaaaatcccctaacaatctaacaagtgatggtcatgtggcagatggtgatcaacctgtacgggtgcaacatgaacaggaaggagtgggagtcgccggaggagtgggtgccggagaggttcgccggcgggaggctcgaggtggcggacatgtacaagacgatggcgttcggcgccgggaggagggcctgcgcggggagcctgcaggcgactcacatcgcgtgcgccgccgtcgcgcgcttcgtgcaggagttcgggtggaggctgagggagggtgacgaggagaaggtggacaccgtgcagctcaccgcctacaagctccacccgcttcatgtccacctcacgcgcagaggaaggatgtgaaccattatattcattggaagctgttgctcgttgaataatgatatatagttatctttgagatgtatttactattagcaaaatctccatgctttgttatggataggagaaaacatattataatatatcatggactatatttcttttatcaaatatggttgtatataacttgttacttgtttacttattctttgttatggataggagaaaacatatattataatatatcgtagactattaattttttatcaaatatggtagtataacttgttacttgtttacttattcaaatatatggtatttatttatgtgaactattcaatagtagcagaaaatatcagggtgccactgtagccttttaaaagagtgcaggcaaagaaccttacaatgttagcagtgaatctttcttgaggtaaacctcaaaagagcacccaatacgacaaatcaaccgtttcaaggctgagatattataatttgaccgacatccacatatatttcaaaccaatttcactaaaacaatcatttataaagccaattgttcattacaaaatattaatcatgacaatgatttcacagttacttatatttttctatatatatacttactttctctaatcgtacggttaagagttacttcgatttctttacggtgttatctaatcctatgaaaaattacttctattttttagttcctctagcagtgtacttgcttctaatgccataaagaattacttctatcttttaaaaagttactttcccctaactatgtaattacttttaataccatgaagagatattaaccactctaaatgccgtgggagcgctgagattttagagcgccatgtcagcgattttttttcatagaagtccccgtacttctggttaattatacattgatcccagttgctatccaccgtgaaccgtttgatctctctctagggttgatcccttgtggtggctcttccgcatgcgtgaaattaatcgttggatgcggaatggatggtgccgatttcgccgactgcatcaaaccctagccccgtcgcccccacccttgcatgagccctcgccctcgccctcaccctccaccctcggtgcatcaccacgctctcctcccctcgcatgtgccatagttgtcgctgccgccgcagtttcgcactcctccaaccatcgttgcggcgccaggcgccgtcctcctcgccggcgtatccggccacccagatgagatggatgcgagtcgctgccctcttcttccctttcatctctacgccgccacaggccatcgcttccctatccctcgccctctccactctgctcggcgaggtgttcatcagagtgtcacggttgtgccattgccggacatcacagtggcgacaaaggaaggagaacaggggaaagcgtaaagtgagaagacgtgtcttcgccaagaaagcgtattgtgtaaagagagtggtaggtgtgtgtgaatgccaagtagggcacaggagacagctgtgtgagtggaggataaaatcccctcgttgttgtactgatacgattacgaaatgagaaatgaaaaagaatctcacctcccccaagttctgtctcttcttctcgcctaagtcttcttcttcttcttccccatgctagttcgccgtgtccctcaactccggtgagctttgccgccgcggattgggttgtgacaagttggtatcagtcgctttgttcggtctcggggctgtctctcacattctctcggctcgatcagtaaatcctgtggctccgttcgtggtcttccttcgggttgtcgccgcggtaaatcatagtttggtttgattgggtttggaggagacgacgccacggcaccagcaaaacctagtgcgcaggttcggcacatggtggcggcgatggaatctatggaggagcgtttgatggatactctcaaggcactagcactcaaggtggatggtgtggaggacatcgccaagcgtttgacgcagatcgacctcaagctggcgcagcaaggcgagtggctagatcgggtgcagacgaaagtggatctctccatgacgtccctcggccaggttcagcaagaacagagtcaggtggcgcgtgcactgaaggcggccgcggcaccaccaacaccaccactgccgccccctccgccgcctccgcgtcctccaccactgcttccatctccggagtagccgttgggagcatcttcatcttcatcaacaccaccaccaacaccaccgcctccaccacctgttcatcggtctcgtcaggtaccaggtcatcaaactgctcctgatgtttctgattttggggatttggggcgacgccagtggactccgaagatggattttcctaaatttgatggtactggtgtccgcgtgtggattgataattgtgaaacgtattttgccttttatcaaattgcggaggggtttatggtgtcagctgctgctctgcatctagtgggggatgctgctaattggtaccaggtgtggaagttagaagtgggttggcatgattggaccatgttaaaaatggctatcgctggagaatttgaggttaatctcaggagtcttaagatggatgaactgattttgttgacacagacggcacagtaactgaatatcgttccaagttcaatcagttggtgtatcagattaggctctatgatccttctctgtctggttcggggctaattaatcattttgtgttgggattgaaagatgagttgcgttcttttgtctaagcggtgcatccaacttctattactcaagcatatttggtggctttggctcatgagggggcacagcttggtaatgtgggcaagagacattttcagaagagagatcctgttgtttggaaacaacctgaaaagcctaagttagccactggggagttatggaaagcacagcaactcaaggaatatcgtcgagctcacgacctttgtttcaagtgtggggataagtatgtgcctggacatgtgtgtgtgaaaccagataatgctcagctaaaggccatggaagttcaggaggatcaggtgattttgtctgatgataatttggatgctgtggtggcatctgacatggtggaagatgattgcaatttatctttgcatgccatggctggtacatgttctgcttctactttacagttgcgagcaatggtgggcaatcaagttattctgattttggtggattcaggtagttcacacaactttgtgaccgctgatttgtgtactaggttacagctgcatcctgtgtcaactgtgccaatttctgttaaagtggctaatggggagttgttgtcttgtgaggccacagtgccttagtttacttggtggattcagggatttcatttttcttttcctatgagagttattgctatgggggggttatgatgtggtgttaggcatggactggttgaccaaacatagccctatgcagtgtgattgggttgctagaagcattcaatttccctatcaaggtgatttgataaccttgcaaggcattcagtctactcctttttctgcagttactgaggcatctgttcatcaggtggttaagtggactcaaggcaattatatttgggctatggcagtacttgaaccagatttctctaagggctccccacctgttgaactagctgttcagtcagtattggataagttttcttccgtctttactgctaccaattctttgcctcctcatcgtgtgttggaccactctattgctttgattccaaattcggtccctgttaattccagaccttataggtattctccaacacaaaaagatgagattgaaaagcaagttttggagatgttgaatgctggtttgattactcctagttgcagtccatttgcttcacctgttttgttagttaagaagcaggataattcttggaggttttgtgttgattatcggcggctgaattctttaactattaaaaataagtttcctctgccaatagttgatgagctattgaatgaattggctggcaccaagtttttctctaaactggaccttcgcagtggatatcatcaaataaggatgttagaaactgatgaatttaagactgcattcaaaactcatcatgcccattttcagtttcgggtgatgccatttgggctcactaatgctccagctacttttcagtgtttaatgaattctattttcgctccattccttcgtaaatttgtattggtattcatggatgacatcttgatctatagtaggagtttggaggataacattcaccatatagagttagtgttacaattgctgcagcaacatcaattgtgtgctaagctttctaaatgttcttttcctcaaaataagttggaatacttggggcatatcatttctgctgagggtgtggctactgatccagaaaaaactagggttatgcaggattggccacttcctagcaatgtcactgaattaaggggctttttggggttaactggttattataggaagtttgtcaaacattatggcatcctggcaaaacctttaaccatgttactccaaaagaatgctaagtttgtatggacacctcaagctcagtcagcatttgttgctcttaaagaagctatgtgttctacacctgttttagcccttcctgactttgctaagccttttgtgattgagactgatgcttgtgccacaggaattggtgttgtgttgtctcaagaaggacatcctgtggcattttatagcaaggcattgggaattgtgaatcagcggctgtctatatatgaaaaagaatttttggctataatgatggcagttgatcgttggagatcttatttacttcggggtccttttgttatcaagactgatcacaaggctctttgtcatttagatgatcagactttggacactgagttacagaaaaaggcgatgactaagcttattggattacagtacaagttccagtataaaaaaggagttgagaacaaatctgctgatgcactatccaaagtagggcatttttttgggatttctgtggttcaatctgtttgggtttaggagattctcaactcctatgctgtagattcatctgctcagcagttactttgtgagctagctgtctcttctccaaatgctaagggtttttctttgtctaatggtttaatcaggaaggctggtaaaatctaggtgggtgcaaattctgctttatagactaagttgattgctgccttccatgcatctgctattgggggtcacactggtgtgctagtcagttatcagagagtaaagaagctgtttgcttgggttggtttgaaaaaggctgtggaagaatttgtccaacaatgtttgatctgtcaacaagcaaagcatgagcattgctcttatcctggtctcttataacccttggtgattccctctgcagcttggcaagatgtttctatggactttatagaaggattacctctgtcaaaaggtgctaatgtaatctttgtggtggtggatagatatacaaagtttgcacactttttgcctctcaggcatcccttttcagccttgcaagtggctaaggtctatctgaacaatgtggcatcattatatgggttgcctaaatctattgtctcagatcgtgataaagtctttactagcaacttttggcagactttgttcaagcgctttgagattcctttacatctgtccacaacctatcacccacaatccgatggacaaactgagcgagtgaatcaatgccttgaaatgtatctcaggtgtgcagtttcttctactccacaacgttggtgtgcgtggctccctttggctcaatattggtacaatacatgttaccattcctctctgcaatgttccccttataaagccctatttggtcaagagccatcttgcagtatggtgcctgagcttactctgtccacttttgacagtccttctaattctcctaatgctgatcagttattccaggaacgtgctatgttctcttctttactgaaacatcatttgtctcgtgctcaaaatcgtatgaaacagacagctgatgctaagcgcacactgcgctcatttcagcctggtgatttggtcttactgaagttgcaaccttatgctcaaaagtctgttgtggctcgtccttttcccaaactggcgttcaagtattttggtccatttccagttgtggctaaagtgggttcagtcgcatataaactgcagctccctgatcatagtgagattcatcccgttttccatgtgtctcaattgaagcagtacattccagatgcttcaccggtgttttccactcttccttctactctgcagttggatgccactgagttgattccatctgagattttggatcgccgaatggttaagaaagacaatgctgcagtggttcaagtcctggtgcgctggggtactttgtcgccggaattggccacttgggaggattatgacgtgctgcgtgctcggtttcctttggcacttgtctggggccaagctggtgctcgtgggggggggggcaaatgtcacgtgtgccattaccggacatcacagtggcgacaaaggaaggagaacaggggaaagcgtaaagtgagaagacgtgtcttcgccaagaaagcgtattgtgtaaagagagtggtaggtgtgtgtgaatgccaagtggggcacaggagacagctgtgtgagtggaggataaaatctccttgtcgttgtactgatacgattacgaaatgagaaatgaaaaagaatctctcctcccccaagttatgtctcttcttctcgcctaagtcttcttcttcttcttcttccccatgccagttcatcgtgtccctcaactccggtgagctttgccgccacggattggtgacacagagccatcccagtagatgctctcggcctccccactagtggatccggttgccaccactccgaccggccatcggcgctggcaacgcgaccgcgtcctctacggcatgctcttgccccatcatccacatcgatttgggtctttgggccactccaaggtctagccttcaagggcatgtccgcctccaccatgtcatcgtagggcaccggtccgctgccttggtcaggtatgcaaccccgttgcttttttttttctcctttaaccctcctaattcttagctttatctgttcatcctaaaactcatagatacgatcgatccaatccgcactggtgctcactctgcagcgtgatcttgaacctgtggtgaatccatggaatgatcccctaattcggtatatactgccttctcatgcttaaaccactaaattatctaataaattttgtactgttatatgcatataaatctgatctggatccttccctatccttatccctatttactgatctcctgctcattcggttgcagaatcacacacagaaaagcaatggcatcagctcatgtgccaactactgtggcttctatttggaggtactaactctgttttttgtcttctcccagtgatatatgtgccattggattgctcattctgttatttaggtgtagttacatggtagctatggtggttacactatgagcaagtactcttctagtctcttgaatctcccttgcttcttttccctttcgaacaagtcatttttctgtgttaatccatttacccactttatttgttgatagaatgactgatgtatgcatttaccatgttctttatggacaatcttagatctgcaatgttgatgctttcacaataatcttgggttattactatgtcaaatctttgaatttgacttcttaaagtttctatcatatctcctttttttgacttatgcttaatctctatgtgcaaacttattccaggtctatagactaccgattccccctaacctcgctttattaattgatgcctaattatctaacctagcatgagtggctatttctttcagacaaacactacaatatttatacacttttacccacataatgttaagtgattcaagcattttggaaattacaggtggtgatattagtcatctgatattgaaatattgccccaatgtttcttacttctaaactttatttgaatgaaccattcgtaatagctcatatgtattgctaaatgcaacaacggagacaaaaataactgttacatttccaatgcaaatgtgtttaataagctcctggttgtttgtctggatcccaatgtgaaataatacttatacttcagtttttcttgcaggtccaacagatggatataaacttgagactgtttctctgaatgatgcgagtgcttatcttctgcccaagtcagctgatctacagttggggaggtttcttctttgagcaacaaggtgggatcattaccttcttttccatccttaaaaatcattagtgctattgcatatacaatagaaagattcacatgaaaacattggttcaaaagtgttcgggtggtctatattttcgtggatcctggtattgattctgccactttgtagtttgttgatcgccgctgtttcaaaccaatagaactaaaaacagagcaacaaagtgtctactgcatcagaaattttatgcatggtataaactgttatgtgttgtttctgaatgcattctacatatatatttattgtgacgctgacaagtttgtttacacaaaatttttagtagcttctttcttggctatttacgcacgttgctgctgtgtatatggtttctgtccagtcttttcaaaagaagcatagtaaaagttgttggattcttacaagggaaaagcatttttcttctataagatatgtcaagatttcaaacaacggttttccactgtagcgttcctttactcaaatacaaattgccatttatgtccacctatttgtataattatattttgtgcttggtctacctcggtatcttttggcatgtgagatgctgttctttcaaatctctgcctcaaatttaatcaattttacacaatatgtgccatgtgtgggactgctattatctttttcaggcaagcatcttgcacatgattgttttggaatttgttactggtccatcctttcatactgaatttttcccttggtaaacatgcttatgaacttttcgttacaagttggatttcacggtatgactttgttaagccatttttttgctaggaattttcattagattatttgggatttatcggtgccatgtttattgcccctcttgggaagatgagatcgaatatactgataaatgagtggccatgcaaaatttagctttagacatgatgtagaacatatctcattattcaatgccactttgcaaaggaagtatctgtcatctactatatagattgttgcgaatacatgtaatgatgtgttgtttattatcaatcttaaaaagacaatcatctttgcatcggcaggtgtcatgaagagcatagctatgcggaaatgttgaatgtttctctgaaagtccatgtttttgtggacttctctaaaaatgaggaagagcgctccttgactccccgaaagagatggatcctagcatcctcgatgtaaattatttccccacgtagtgttagattaccatatcgatgtttacataccggacatttgtatttattatgtgccattaactatatattccgcgcacgcagcggagtggctgtttctttctagtacttattatatgacaccatattgctctttccaaaaaaatatagcgattacttccaaataaaaaaaataattgtatttagtcatgtaatcttctccacattttacttcgtatagtttcttatttcaatatagtgcgatatgttttctttcaatgctagagaaaagtttcttctattgtaaaactgaaaactatgttacttctacaatgtgagtaaattactattaaatataagaatatactcttggactcaatttatgatatattttgagtgtagtacaatggttaaattggatcttaaaaataatgcacggtttaaaaatataaatcatcgaaggttccatagaaaaatatcagtgtaaagagattatcagtgtaatgatggttgattggttgatgttgtcatgcgcacgtggatagacatctcttttcacgtacaattttagctaattccttctatgcccctgaatttttcttacttgtatgcccctaaaatttaatttggatcccttccatacccctctttctagttgaccgtctaatttctataaaaatgaccattttaccctttggataaacatagaaatttatgaattatattattgaaaatgtaaaagtttatcgcatgagactattatagttatgagtttgttgtgcgatacattatttatgaaaaaataattttagataatgaaatagaaaatgtatttattttattttttaaaaagctataaaaaatgaggagcattcatacaaagatagactactaatgctcatgatatttttttatgaatgcttccattctattatcctattaaaatttcaaataagaatttaaattattacatctgttttattttcaaaatttatgtcaaaattttctacactaattatttaatctcattaatttcataaaatgcacatattttgcactcaaacaaaattttcaatcgttttcaagcgtatattcaaacctaaattatcaagtatataaaagacatttgcaaccaaacttagcagcaaaatgaaggaaaatgtaacagcaggggtatggaagggatcaagttgaaatttcagggatatagaaagaatcgagtaaatttcaggggcatgaagagaattgggtgagttttcaaaggtctagaagaaatttactctagatttgatactttataagtatcgttcgatacctgaaggtaccaactgatacctcttcggtaccagttgtacatattgatacccgatacatatctaagctgagagggcggagataagaaatgatgaagatggtttattgataagtctagacgagaggaggaggaggaccaggtaactttatgtatactttctatatagttggtacccactaacaattattagaagctaaagctcaatatgcaagcatgccatatcatcacccactagcaattactattctagcctatttaaatctcatgcaagtatgacacatcatctacaatattatattatagatatcaagagtaaattgcattggcggtatataaacttgttgggtgagtgcaatttagtacataaacttgtaaaatgttcgtttcagtacacaaacttgtctagttcgtgcgaacgaggaccaaaataacttggcaatgttaattttacgaagctgatgttgattaggatctaacgtgcgtacgtctagtgagtatgcataagaaatgcaatatttataaatttggtctctactttatccttcatcatggaaataatgaattttatatatttctaacccttatatcattgctcgaattttttaatccttttctccaatcactatatcctattctattttttattgaaaaggtgtatgtctaatagcaaccttctcagatatatgtttacacaatatcctaatctgcttctaaatcaataggattagacatgtagtgtccttttcaccttcctccacatgcaccagataagttcatgcaccaaaacgagcattttgcaagttcgtgcactaaattttgcacccacctgaacaagttcgtgtaccggcaatataatttactcatatatcaataagtatgtgtcaaatcatcttcctcaaattattttctcaacatttcaacttttatcatttcaaaaatatttaacatatattcattcatgaatcccgcggcaatgcgcggggtatcacctagttgatactataaatgacataccaaaatcccaataaaaacatctttaattttaataatagtagagatagagattatgttgtatcgcaacaattgtgggatgtggtatacatactatacgaaaatggacaataaaaaatagttcctgttagaggctagatttaattcctttaataaatatttccaacaatgatttattaaagaaaattttatttccaacaataacttcactttgtaaatggtttaagttttagtataaattatcgaataattttaatccttgggagaaaatcagagcatgacagctatgagtcataatcacaagcgtaatctcgcaggatagctaggccgaggatgactggctcaggagaaggctcctaataggggccaccttggttatgtccgatgggcccatgataggctatgaaagggtaagaatgcccctgtaaatagccaaatcaaggggataatcatataaaacccttataagtaaactctaaggtttgtttatcatgcctgtaagttataaggacatatttgatagggctgcaactcttaattttttggggcaatttcgttcttgcccctactccgatgtccaatattgattttgcccctggttttcaagattttcgtttttgcccctacttttttgaaatgaaacaaccatttgcccctattctgttaattcttactaaggtgttaaatgtggggtaaaaatgataagtatacccttagatattttcccgtatttttgtacaccacttttcaaatttgacctaaattttggcaactttcacaaaattttgacaaattaaattactgctataatgacagcaatcaatttttattttgattatgtcaaaagtacgggaaaatatctaagggtatacttgtctttttaccccccatatttaacaccgttagcaaaacttaatgaaacaggggcaaacggttgattcatttaaaaaaaagtaggggtaaaaacgaaaaccctaaaaataggggcaaaatcaatattgacaatcaaagcaggggatacatggtcctagaatgtattacatccctccaaaatccattatattataggacggagggagtaattactttattatttttgtccaagtttaagagaactgtttgtctttcgatgataaattggccattatagcaatattaattgtacacaagtaatttcaacgattacttccaactgattcaagctttagtacgtacatgcttctgaagtagttgtcctgagcagtaacacattgtttgaactttgaataataacacaccagcaggaccggtggctatgaccaattaatgaactaatctgtggtgcgggtcatttggactccaaaccgtgctgcagttatcgccattgactatcagagtgcagtgttggtttttactatttttgttcgtgtatggatagtaccgaaatttcagaaattacggtagttttgttcttaaatattttttttaaaaaaaaatagtttaaaattgaatattttttaccaaataaatccaaaattttgggtaaaataatttcttatcagggatctgatagacccaaaattcccaaattttcgctctgtagtttcaaaccatgctcatgatattggtaaaaaaacgtttgtttgactagctttggtgagccaaccagctgctggtattttcggaaaccatgctcaattacatcttctaacatgaaaacggagggagtatatcgatttatataattttcggaatccctgagatccgaaaattatgttaccttctttaaaaaaatagatataattttcggtggcgctaatacacgctgcgcgcggaatattagttcgagcgccgcacaatgctccctcctttcggttttacccttttttggcacccacctttcctctgcatcccaccttttctctgtccgtttttttaccaccccacctttcgtgttttttttctcttttccatctcatatgcgctccatgaaagggcctgataaaatattaaccatccagatttcgtgttacattcattctctccagtttttctgtttttgtgtttagtaaaatatttgctgttagtttttctttccgagttttctgtttttacagtctccccacatttcaaaactaacgaatttactctggcccagagttttccatctactcccagactcccacatctgctcatttaaaagtgacaaatttactcacataaatacccccttcaaaagtaataaatttactcacatcatacggcaccattcctagatggctgtaaaagaattactaccagcttacaaggacgcgactccggctcaggcgcccgatgggaagaggttaaaatcgggcgctgatgtcagcatgacgtcagcagccgatttacgtgcaaaactactttaaactgatttttctcttaaattacttatccaaatcatgatctgattgcaccattaaattcattacaattaaatcttcaaaacaagaccacacatggatatattctgacgaaaaaaatttagcttattattgaattatttttaaatattgcacgatgttccactaggtatatcggaatggtttcatcgaaaatgtttcactcatttaaatcaggtgttgtttcaccttatataaaaataatgtttcagcaaataacgaaaaaatgtttcagttcactgcaacatttgatccatatatagtgaaacattataagtatactaggtgaaacatttttcggcggaacgaaaaatgaaacgaattcccttaatagggggtttccaaaatatgtgggttttttgttgcaatggaatatttcagttcactgcaatattagacctatacatagtgaaacattgtgagtacactaggtgaaacattttttctggaacaaaaaataaaccaaattcccttaatagagggtttccaaaatatgtgggtgatttgttataaatattgtttagacttcatggtctgcgagtaagataactagcaccttcctctcgatataacctatgatcttatagccaccgtataataatatgtttactgatgtgttcaatacacagtataagagtaaaaactgatactaaaaactgatactaagagtattattaatctgtatcacaaaatggccatacgagtaaaaaaattataggctcaatcatacgcaagtgataaattactcacaagtgaatcaaactagaaaagaaaaaaaatgattcagtcaaaaatccatcttgaagctaggatcctggtggctttgctagatctttttatatataaggatggagaggttagtctatgtcttgtgactggtagtggatagggcaactgggtggtgagcggtagtcgatgatggaatcatagaaggatgtagcggcgtggtatagagatgagcttgatgatgcgaagtagcagccatccatcatctagcaagcataaaaaaaaatgcaaaaacactctcgttcctgtcatagacacgacgagccaaagaaaaataacaaacgatcaccatcaccagtggacttcataatatcctctacctctacggccatccacatgtagcacggtgtgtaaatgtagaacctgtgtagcccatcaattcacattaggtaatattggagattgtacgttaatttgatttgcaaaaggaaattgggcttcatgcatgaaggtgaaggagggtatacagatgcaaattggagtgccatttccttacttgcttgtcctatcaatcaacgtcgtcgacgtggagcagccgccggttgttgctcttggcccaagtgaacacatccttgttggttacggtgctacccagcgtctggcaatgaggccccatgcaacaccttcgcctcaactgccacggtgccgtcgtcctcctccatggtgcgtcacagatctatgggctaggatggtgaatcgatttagatccaaaaaaaaagaggaaaaaatgaagtgggggtgagagtggttagttgggtacatggaaaaatataatatataccagaagtagggaagttgattttatcgaaataaatcatttgctccaataacgatgggagcgggatgatgggatgtggaaactggaaagttgtttttatcgaaataaatcgtttacttcgataacggtgggagtgggataaagggacgtggggcgaggtagacctgggctgatacatgtttggtgctcagaatactaggagcgcagcataattttatcgacctaagttcccaagtcaatcaaattgagggtaaaagaaattaagcgccatgcatgaacatatatgcgggttcggacagcgaaggcgcctctgttcggctgccccttttcccagccccctctccctcgtttttcgcgtatacgttttttaaactgctaaacggtgtgttttttaaaaaaagtttctataagaaagttgcttaacaaatcaaattaatttatttttaaaaaatattagctaatacttaattaatcacacactaatggattgctatgttttccgtgcgtactgttcccattggggaccagcaatggcgaacacagccgcagccctatatataatactagtactaaaccggggattgatcatcaagagaatgcagtgcaagtgcaaactctcgcagtgagcctgtgtgatcgatcgatctgagtaggggtcggccatggagtcgctgctcgcagccggtgcgggagggatcggtgtggcggcggcggccgtcggggggtttatcgcggcggcgacactcgccgtggcaccgcccaagaaccgccgcaacccgcctccaggtaaccggccggccgggcccgttcgtcgatcgttcgatcgatccattgccgtgttttgccgtccgcttcctggcctgtggatatatatctacctatctagcttcattgaaatgttggagatggcatgcagctgatgaccctaattagcgatgaaaatggagtggatagtttctgctacagaagaaaaatgaatacggatatcgtgcggagcagataattattggatagtttttacatatatttgttttcccggatgcgaacaagaatatggtatcagaatttttgtcggatacatatatcgcatatctgctgaagacataaaacatataccatttctctctaactcatctttaacatacctctttagattttattattaatattatttaaatttttaaatatttttataaaatatactatatttatatattataatatcagttatatatgtatttttaccaactctgttatacatgcatgtagaacttaattagcactgtttagtctatgatcaaccttattatataaaaagagctaattatgtgtgttggtgtttgtttctattaaatgtttaggtggtttttgtgttccgagaaataaattcttggtattcgtgtcggatatatttgatgattatttgcattagagataattcttatttgttttcatatccgacctattcggttttgtatctggaaaaaaaaatacaaagatgaatacggtatgacccttatctgcataaattataaaaatacaaaatcaaaattatcttcataaattatacaaaaaaatagaaaaatgtttgtagcaacaaaatcacaattatatgcatgtaaattcaaatataaattcaatgatattatttttgtcaaataagacataatttataataaagtattattggtcaaaatttaaagaactgaatcttaaattgagtgcacaacttactaagtgggacagagggagtactacactagcttacccccacggtgtaaatattttttcatcttcgtttttattaaactgacaacttaaaataatgcaccacttttgttatagaggctataaacttctatattaattgaagaaaaagaaaaataagttcaaatacagaaataacataaatttgaaattaaaacaagaaattttcaaagaaaagtctatctaaacataacatgagattaattaaaattgagaataaacaaataaaagagttcaaataaaaatataatttgggaataactaaaactcgtaaaaaagaagtactaaaaagaggagtcaacctgtaacacaacacgagattagttatattcaaaataaaaaaaatataataaactatattacaatactaattccaaataaaatttaaaagaatcatgaaaatttgggaaaaaaataaaaataagtaagacaacataccaagaggagtccatagaatatataataattaaatattcaaagtatgatttaaaaatatagaaataacacgtataaaataacatttgtggggaaaaagaaaaaagagagtccattcggaaatacattttatatataactaaaattggatgtaaaagttatggaatattgagagaagtgttggtctaaaacataacacgagattaattatggttcgagatgaaactatatttatctataatattattaagatattcttggaaggagatatcatgtttgcaatggagactagaatttacaacattaattgtagaaaaaaaacaaaatctacactgttagatcatggtggaaccatattatgttgaatccatgaacaaatttgactagctgtctgctttccagtttgaatacaagggtttttttttttaattggacgtagatgtgcgagggtagcatggtcctaaaatatcaggatgtttagatcccacctaaaattttacatcctgtcacatcgaacgtttgaacacctgcacgaagtatatattaaatataggcttaaaaataactaattacacagattgcgactactttacgatacgaatcttttaagcctaattgctccatgatttgacaatgtggtgctataataaacatgttctaataacgaattaattaggcttaataaattcgtctcacggtttactgacgaatactgtaattagtatttttattagtgcccgaacaccccatgcaacaccctatataataactttacaccgatggatctaaacacccctagaatagaaaattccatttctatccacgtaagacaaagacaaaagtatgtctgtgttggtaaaattagagtagaaagaaattttgaatagaaacaacacttgtcgcacaggaaagtgaccaggtctgcatcctgctcaatctggtactatcaaataattaagtatgaataagtgagaagcagacctagtctgcatcttgctcaatcatcctagaatagagactagattgtagggagtatcaaatagtaactgtgattgagcatgatgcagactggtattgatggttgaatataagagaaactttggtagtgtgtgattgtgtaaatagataaaaatgcacattatcaacatgcaaatatgtgaatatttgtttttgagtaatattgttagatattaaaactttaaaaaaaatcaagttgcaaatgtgcggaccaccctactattttatttaaacgaactataaatggaggtgtggttggtggaattagagggccgtagaaggaattagaggttatggtgcgtaaggtgtaatggggccttaaaacttaacatgttatcacgatcaacgtgatatgactcgtagaactgtagaagatggatagcagaatacgaacaaacggccaatcacgacgactcgtagaatatgattacacctagttctaatcgatttagctttagatattaagcctattgtgccttccgtttttagttttgggtcttagttctcgaattaaatttaaaaatatactattaatttggtttttcgtagaaatattcgtgatatatactttttagcgaaaatataccagtgtcgcgtggtaggagcgcaagaccgcacggtatcgtgtgatgaagcatcgagaccgaacagtctcgtataaagaatcagcgagaccaaatgtcatgtccaacggagctacttaattagtcattaattaccctaattaatgattcattaacaataattagtgattaattattctaattagcgattaattaatcactaattaaccttattcaatcggcagaggcagtcgctatcgctcactgactgagcgagactgctcggtctcgcggtttggccgcgcgagaccacgtggtctgacgtcgccaccgcgtacatcctcgattccgtcgttcagtgctatttcgtcgtgcgagaccggtctcgcgctatgatcacgcgataccgtgcagtctcgcgttctcctcgcgcgagaccgttcacgacgtcactcccacgtcactttcgcggaatggttatacgagatcgacggtatatttcttctaataaatttacattctgaatatttttgagaaaccaacgaatgaacagtgtatttttaaatttaattcttctctctgaccatctggtcttcattttagtaatgccgctaattaagcatatacttagcactccatgtagagcttgtttagatccctggcaaattttttcatcctgttacatcgaatgttggaaacatacatggagtattaaatataaacggaaaaaactaattacacagattgcatctaaattgcgagacgaatcttttaggcctaattgctccatgatttgatagtgtgttgctacagtaaatatttgctaataatagattaattaggcttaataaatttgtctagtaggttacggattaattaggcttaattcgtctcgcaatttaaccatttttaaattatttgagcccacggtttttattatttttccgagatataattgctacgtaagcgccacgtcaataccacgtgggacgaagacctagtcaaaccagccatgtagttggcacgtcagttaaaaccgccttctaaatcgtcaagggatcttgtttgtgccggttttgacagttcagggacctgttatatctagttttggggtttaaggacgaaaatcggattcggtgtaaagctaagggacctcaaatgaacttattccttatttcattgtcatgcagctgttcctggtttacccataatcggaaatctgcatcaattgaaagaaaagaagcctcatcagaccttcacaaaatgggctgaaatttatggcccaatctacactataaggaccggggcttcttccgtagttgtgctcaattcaactgaagtagccaaggaggtaacttagaagttgtctatcatttctatcgacttgcataactctaaaatgatggtctcacatttgatttgatcataaataacacaaaccaatactgtactctcttttgcaggcgatggttgcaaaattctcatccatatctacccgaaagctatccaaagcactaacagtgcttagtcatgataaatccatggttgctaccagcgacagtggtgatttccacaaaatggggaagcgttatatcatgttaagcatgctgggtacttctgcacaggtatacatctcaacaatttcatttttcatttttagtactgattgttctcaataactccagtctgcatttccaatattgattatctgctaccagttacactttcagagtttcacttatctgtggtctaacaacgcaacgcgttttcataaatttcagaaacaatttcgtgacacaagagatatgatcatcaataacatgttaagcactttccatcaactggtgaaagatgacccacatgctcctctgatattcagagatgttttcaaggatgagctattccggttgtccatgatccaggtttggattgtctctctgaacttgaactgtcagatggtcgatttgttattttcggtactaataattaatgtcgcaaacttcagagcttaggagaggatgtgagttcagtctatgtggatgaatttgggagggacatttcgaaggaagaaatctacaatgctactgtgactgacatgatgatgtgcgcaattgaggtcgactggagagatttcttcccctacctcagctgggttccaaacaagagcttcgaaacaagagtgtttactacagaatctagacgaactgcggtgatgcgcgccttgatcaagcagcagaaggaaaggattgtgcgtggagaggtgagcaaaggcatactttgtcaaatgacatttttcatctttgcttctatgccaaaataatgttattacttccagagatcatctttttttttttataatggaatagataacatcccgactttttgctcaataaacagcccattattacaaagaatcactcaaacaaaagagtgtagatcaaaccaaattaaacacactcaagaaaaaaaataaagcgaccaaaccaaagataaagagcacacaattattcaagtctatttgtgaatctttatccataattgacaaaaagttgcatgatcgtcgtctcaagcttacgacatgcaacctttagaagctctccatcttcatcacacttttgtagttgtgcccaagaccggagccaatatgttgccctgaaaattgcctgcatatatgagaaagatggtaatttgtcaataatcaaatcattactactcaaccactgagcccaacatatagtagatgctcctacaagtattagtttgctcttcttcttgtcaaccccaaaagccaaccatcaaacatatgggatatggtattagggaggtataaaccaaaagcaaactgtaccgccctccaaacaaatttcgcaaaatgacaatccataaacagatgttggatagtctcatttttcatgcagaagtaacatcttaagcttccattccaatttcgtcttgctaaattatctttggttaaaacaaccccttcgagcaagtaccacatgaagattttaatcttgagcggcatcttaagttttcaaatgatcttatttctctcaatataactattattgattaaggctaaatacattggccttactgaaaacacaccattttgatggtaattcaatctaaagccatcaggaaaatgattcaattgaagagatcatcttcttttgactccatgaaactgagatatatgtgcaggcaaggacatgctatctggacttcttgctggcagagaacacactgacagatgagcaactaatgatgctagtgtgggaggcactcatagaggctgcagatactaccttggtcaccacagaatgggccatgtatgagcttgccaagaaccctgacaaacaggcaagaaatattgttactctgttccagctcatttttggcattcttggctttatcaaccaatacttttttttttggtctttttcttggcattcttggcatttatgacaggaacggctttaccaagagatccgggaggtgtgcggcgacgaggcggtcaccgaggagcacctgccgtggctgccgtacctcaatgccgtcttccaggagacgctgcgccgccactcccctgtcccgctcatacctccgaggttcgtcaacgaggacaccatgctcgccggctacgatgtccccgccggcaccgaggtaagcacaaccatgtgacaatggcgggccggcagggtttgcactttcggtttcggccaaaaatttcacaaactttggtgtttttggtacttctttttgcacgaaattatttgaaattttaattgaatttgaataaaattttgact

SEQ ID NO: 858 - DNA, 4685 bp, Oryza sativa
gaggagcaccgccaccacgacgaactctaagctcatttaattgtgtgttttacaacagtaactggctaccgtttggaggcgattgatcgacgtcgtaacaaaataagcagttcgttaatttaatcacctgtagttgatttgattgcatgctcgtattttttgcaatctagctcgattatgtttacgctgtgtaatgattattgattattaatttgaaaaagattgttaagtatgaattttgtccgatattttctaattttcaattttcatttgcacacacttctgtgtagcacataaggtcctaagtttaaatctccataggagtgaatttcaaactaagtttctactccctccgtttcaaaatgtttgacatcattgactttttagcacatatttgaccgttcgtcttattcaaaaacttttataaaatatgtaaaattatatgtctataaaaatatatttaacaatgaatcaaatgataggaaaaaaattaataattacttaaattttttgaataagacaaacggtcaaacatgtgccaaaaaatcaatggcgtcaaacatttcgaaacggagggagtattttttttaaaaaaaatgctgcatatatccagttggatatagaggccgagtaaaaaaatacccttctcttagaaaaaattgcacacgcttcttaaatttataaatggtgtccttcatacataacaattttcttagagtgctggtctaaagattcatttgttcgtacttcgtacccttagactgtaatgattttttttaaaaaaatctatcaattttagttttctcaaacaaaactcttgcgtttttttaccggaacaaagactattgtgttgggaagaaacggcgccggtttcaggtttggcatgacgagcggccacatggaggcctagcccatgggaacgctcttccggcccatggattaggcccataaaatcggcccacaagctacctacacctctctctcgctaggtggtttgagaagaatccatctctctctctctctcccaatcccccaccaccaccgccagccaccagccactgccgcggcgggaatccggttcccgcggcgacatcccccacgtctccgccgctgcaccggcaaaggcagctgcaccgcgacccacccgcgcgctcccaatcggccccaagattaagattaaaccaggagagaccacccgatcgagtgttctctcactttcgccatggaggtactccgctacatcttttcctgcttctcctcctcctcctccaaatcatcctcagcatctgcgggctccgtgagtatcttctttaattgctagtacgtaattgtgattttactgtgcttaattgttgatccagtcctaataaggctatattactcgctagtctgagttcttgtggtactagtaattagcgaaattatggggagagttctccataatttaggctaaaaccttgtcagttattgttaattctaatcaccaccggcagcctgattccaacatttgattatggacttacaacgaattgaattagaattttatgccgactgttaattgttactagttcctttgtacctttgggatatttgatgatgatcttgattcacataagataagataatctacaacaaatttcagtgtatgtgccaaccatagttgtcgagtgccatttagagcgttgaaggggattgatttcaatctcatatgcctcatctctcatgttgctgtttttctctgggaagaaccgtttcatgttgctcctggtgctgatactgttgcagcaccgactgtggtcaagcggggctagcgacaagaacaaggcaatggttgagcagctccagaggtacgggattatcaagtcgagcaaggtcgcgcaggtgatggagaccatcgacagggggctgtttgtgcctcctggtgcttctccctatttcgacagcccgatgcccatcggttacaacgccaccatttctgcgcctcacatgcacgcctcttgcttggagctcctggagaagcaccttcagcctggcatgcgtgctctggatgttggatcaggtctcccgtatctcatatattcagtttcgctcaatcacttcaacgttttatctatgctcctaaaatatcatttcaattatgtatcatcacaacagaaacacttttgagttttgatgttctcattcacaaaactatgttatgaatcttaagtgccaaaatatagaattgcttttgtttttgagttacaacttcaactataggtttatcattacccaagatctgtcagtggagtagtatcttatctaatagatgtacttatcactgcacactttaggctttgaaatgcagaaatgtttgccaacatatgtggaaaaaacaatatttagcttcatctcacagcttttccgtgagggtatgtattcatgtggtctatgatgggctggcccctaccctataccacaaagattcagtagtaatgttggtttctttcatctttttttctgtcatactgatttatggaattaaatattgattcaggactgccgacctgtttaatatttcctagctgaaatgctcaacagatagcaaatttctatacatgtttgtcaactcgcattgcttatttacgtatctttgataacttcaacaggcacagggtacctaacagcttgcttcgcgattatggttggaccagaagggcgagcagttggtgttgaacatatcccagagttggttacttcgtctattgaaaacatcaagaaaagtgcagcggctccacagttaactgatggatccctcagtatacatattaccggtaagtagcgcaagtttgcagcttttaattgttcactttcctctccactagtagtaatgacaaacatgctgaagtgccaaggtctgaactgaattgcagcgtagagtacaattttgtagacaagggcttagttgcaagggttaaatgatactttaaataaacatgttgaacttctgtaatttgttttaaagggttacttttgtcgggtctaacgtggtaacaagttgttttaggtttcaaagagaatctttttatccataccaaacagtgagtggttcttcatctgtgatacttatgctttctagacacagacttggagcaactttgcccatccatctcataaacttatattgtgcatccgggttggcttcagcagtacttcatattccaaaacattatttacctaacaataatcgatctctgtaactgatacagatggcagagaaggttggccagagctcgcaccctatgatgccatccatgtcggagctgctgcaccgcagattccacaggcgttgattgagcagctaaagcccggtggcagaatggtgatcccagttgggactatgttccaggagctgaaagtggtggacaagaaccaggatggcaaggtcagcataagagatgagacggctgtgcgctatgtgcccctcacaagcaaggatgcgcagctgcaggctaactgaatgcactaccataatattctgctgaatgtaaaaccttcaatgcgtgatcccagttacatcaagatgttattattgtacataaattggtcctaccgtatgtgtgaatcgcttggtgcttgtcaacaatgttggatgttggttcgtcatgaagcatggaagtatgtgcttgtgttgatctcttttgcctctaatggtgtttccactacaatgtgcatgacatatttgttatcttcacaacacggttggcttagatgtaacgtatcctgcagacttgatcagctttgtgacattaaagggattggagtgtccatgactattgtggtttcctgtgcattatatgaacaatagtttatcaaagtatttggttcttgcaaatccagagaacaacatttctgaaagagaaaaaataagcataatgcataggggtaagcactggctgctgccatgcatttgctccttttctcagatatatggtcgacaagtgaacttttggattatcacggaaaaaaaatactaaggacatcatcattataaatatcctacttggaaagttgaactcatatttttgagaataatttaacataacatcagcttggaagacacataaaaaggacgggaggactcaaaatcaggaagctaacgcgcgctctgtaaatgacaaccatcagcttccgccttaacgcataacactttagcattcttgttcaaacgtgcagacatgctccccaacgccatatggaatcaaaagcctcgctgtggtcgctcagctgccacattcactcgaagtgggcggccatccaattcctgtaatccatcatgaacaattgagcataataaaagaagcataaaagaaacggtattagcttatagagcctccatatttgccatactcgttataatggtgatattcaagtgtatgcttaatgtagatggtgccgtcctcacctgtccatcaagggcagaaatagcatcatcgagctcctccttggaggccatggaaacaaaaccaaatccccgagaacgcccagattctctatcgtagacaaccgaagcgttaaccacctctccatgctcgctgaacaattgcagcagcctagagtcatccacttgccatggcaggttgccaacataagccctgaaagcaggagcaaactgccttggaggtctctccacacgagagcccctt

SEQ ID NO: 859 - DNA, 4422 bp, Oryza sativa
gtgaaaaaccaagtcttgttaaattcaattctgtgcgcccaatcacctaatactgaaaaaagaatctccacccttagatttctgttggggtagtttaaatcttgaacttgaaattaactccctatcatcctatgagagccttcttgtgtggtgttgacaatctgttcaccttcacagccaacgccagtgcgcttaaagtgagctgtgaacttctacggatatttgtcacaggtatgtacctcttaaattgttctattgcctcatggtgttaagtgacatgaagtcaatactccatagctacagtgtaactagagaaattttcttgcagaggctgttcaacgttctgcttttattgccgaagcagagggcacaacaactattgaacccacccatctggagcgtgtattgccacaacttcttttggacttttgaggtacttcagggatctcttatctctagcttccaaatctataaggttgcctctggcagaaagatataaaaacacctaagcatatagttttaaactatggcatcagcaaaacggtttattatctgaacaaagcaaaatcgtctggataaatcagtttactgacttgatgtatacacatacaggatacaacttgtaccagctagtgcttttattttgggggagaaaagcttgtggtcagatggatagctaagggacccgagcaaaattcatactcgagaagcctgttaatgctagtaccacttgctgtgaatgcgtaaaaatgacctggggcaacaacttctactaggatccgtggatttctggataatcactgtactgcatctttacactgatacctgtgctggcatgtcctaaataccaccttctttgacaggcacgatcttggtcatgtccacactgcagattgcttgataatgttctactagtatctaaatataaacaacagaggcgtttgaacgagatgctttctgtcactactactacgagttcgctgctgacagatgatgggcgaaccctgctgatgcaggcgcatctacggtgatttggtgaatcttcaaccttcacgatctctcggtctcttccgaattcaggagacggaacacccgtatcgtatcgcaccggggcagagcaaccagccaacccgcgaagtagtactgagtactgaatggaaggtctggataggcaggccacgcgcgcacacccgtcccttcctgggcggcagccggcaggcacccgtcccccacccacgctaccagagttcgccggagaggcggccacctgtcgagagggagcttctccacacggccaccgcagcggcaaccacccccaccacctgtcctgctcccctcctcgtgccgcctcgtcctctttttaacgggtttctgacgcacggggggccgccgtcatgtgcctcgccgccgccatcgcgtccgcgtccgcctcacccgcccgctgcctgtcgccctcctccgccgcgctcccccgccgcttcctccaccacctcctcctcgccgcgactcctccccggccaacaccgcccccgccgccgctgcgctgcatcccgttccaccggatggcggtaagcgttggtgctcctcccctcccctatcgattttctcctgtggcaatcccgattccgtggaaatttgtgcccggcgatgcccaaccggaacctgctccggatggctcctcgtgtgacctgttagggtaaagttgcgtggctaattttggggaatcacttgaaagcgcagatgtccaaaccagtgaatttcggaggtgtgctggattgctcagctgtttgctttgcccttgtgactaaaaatgttcaccttttggcgacctaacttcatatatagggactaccttaaagtgaaatccatgctgtaaatgaatcccgtatcttaccatgtccatgtaaatgtgaatttacattttaggtcttgtgaattcgtggttgctttccaaatgatccatgtactatagaattatgatgagtgaacatttaacttttgagctctgtcgttcccccccaaaaaaaaagtttcagcattgtggatttggttgttttccagatgcatgcactactttcaagaacaccccatgtattagtttcaagctatgatcatacctgcgatggatgctttcatctgaccattgcttgcttgccatccagcaattctggactcaaggatcactggacaagaacaaagctcttgtcgaatacctgaagcaatatggtgctgttagaactgataaagtggctgaagtaatggaaagcattgacagagcattgttcgtagcagagggccttactccttacactgacagccctatgcctattggttataacgcgacgatatctgctcctcacatgcatgcgacctgcttggagctactgaaggatcacttgcagccaggaatgcatgctctagatgttggatcaggtattcaggttcattactgaaacaccatactcctgtagtcctgtactatagcaaatgcggttgtttttagagtgccctgttgagttttctagaccatgcagttgtgtgaacgacttgctgttatccattagtattagatagttgagatacaaacaattttctaactattgacacatttcatctgcatgtgtaactcttgtaggcagcggttacttgacagcttgttttgcaatgatggttggaccagaaggccgtgcagtggggatagaacatattcctgagcttgtcgctgcttcgactgagaatgtccaaagaagtgccgcagcacaattactgaaggatggatctctttctttccatgttgcaggtatgctaagctgctaactggtctgatactggcactagaattagtgtattactgaacgcatgctttgcttccatcttggcgaaatctaaaatgcaaaatcactatgcgcataatatttcttgccgttctcaacgctgcagatggcaggcttggttggcctgacgatgcaccatacgacgccattcatgtgggcgccgcggcaccggagattcctcagcctctggtcgatcagctgaagaccggcggccggatggtcatacccgtcggcagctacttccaggagctgcaggtggtcgacaagaacgccgacggctcggtgaccgtccagaacgacgcgtccgtccgctacgtccctctgaccagccgctccgctcagctgcaggattcctaaggtcgacggctctaggaggtcatgaaaacacatgtaaatatctcgacgctcagtctacttgggtagttgggtagtttgattagtgctaattagtttcttctaacgaggttgagtagatggtttggtctgagacgttcagtcatggtcatctgtcagatgctgtagatcgagcgtgagctctgagcaatactcgataataaccaataaaagtacttcttagcctttcatatacgtgatttgtttcatgctaggaatgggcttgataatttctccattgagaatgttgttagtttggaatttggatggaagagaacaccacgcgctacgcagagatgtttctgtctcgaacacctctgttccaagttcagttccaacacccacaaaatagttcttttgcacaaatagtgagaatctgtaaattatatactctccctccattttaaaatgtttgttcgaccattcgtcttatttaaaaaaaatataattaactatttattcttttcatatcatttgatttattattaaatatactttcatgtacacatatagttttacatattttttaattttttttaaataagacgaacggttaaacatgtgctaaaatgtcaacagtgtcaaatattttaaaaaaatgtaagtaactatttattcttttcatatcatttgatttattattaaatatactttcatgtacacatatagttttacataattttcaatttttttaaataagacgaacggttaaacatgtgctaaaaagtcaacagtgtcaaatattttgaaacggaggaagtacatccctaattataatactagatgtacatctcaagatttccatgagttttagcagtaagttggctctggcacctacatgtaaaaacttcacatgggcttgaagtttctgtacgagatgaccgcgtaaaacgggtcggacgagcccgccatcccgaacagcctcatcacggcgtccagcggcgacgccggcttcccgccggcggcgtcggagggcagcttcctcaccacctccggctccgtgaacccgtcgacgcactggaagtactgcgtcacgagctgcacgcggctgtaggccgtgccctcccgccacgccccgatcgccttctcgtagaacatccggttgctgaagctcacgatgcacactccccccggcttcagcacccggaagatctccgcgaaaacctacacgacacaaaacaatcaagagatctgg

SEQ ID NO: 860 - DNA, 6550 bp, Oryza sativa
ctatagcccgttatccttctctctcctcatttatcttcttaaaatatatttgcagctggcttatagcctactattatgcctgctctgagcacctctatttatttagtccaaagtgttgatacagtagtacagtagatctcaactcccttccgtaccgaacaaggactttttttttggtttggacttaatatatttcgccctttaattcctaaggtggagtagatgctacacgcatagatatttctgattctagttatagtaaacatttgttcggtcaataaaacatccatttattttctacagaaaaactagtacgtagtgactgatgtctacgtacgtgatgtaattaaattaccggcgttagcgtggcccgatcgatcgatcgatcgatcgatcaataatgcgcgacgcgacacgatgagtttacgcgagaccagcgaccgatcgatcgatggatggagcgagcgcgtgcggggtgttacaccgaaattaaacatggcaagatcgagcgagaagtacgagtcgcgagcgagttaggaaggggtacgtcgcggttggaccccgaccagggaccgaccagcggcaggacgtcgccgtcccccggctggaccggcctttccgagacaaaaagcaggtgcgcacccaccaaaacctcccacgcacatctgccgcgcacgctaccccctctctctcgccttaaatgcttcccccgcccccgcccagccccgcgccggccgccgtccgtccgcccgcgcgcgggacacgtccctactccctaacccagatccccgattcggcacgcacgtagtacactcgtgagtcgtcgtgaccccaagccgcatgcttcccgatcgatcgatccaacacgcgcgcggctgcggattcacgtacacatcgcgcgccgcgcgcgcgcgcgccaccgcggtttcagacgcccgcgcacacgccgcgcgcggttacagcgtttcgttcgttgatacgagtagtttattgtgagaggttgtggttagctagctcgaggcgcggacgcggtgttatgggcgttgccgtgcactggcggagggcgggcgattcgcttcacatggggggcgagccgcgcgcgcgcgcggaggcggcctgggcggctgcgttgcctgccgcgttggttgcgctggtgcgcgacacggctacatacacacggtaggggtgcaccgccaccgccacggccactgtgcccgcgggtgctttttcttgaggctggcaccggtgcacgagttgtgtgtgatgacgtgttcgattggatatacattatattcacacacctcaggccgggctggctttgacctgctcagaaatccgtgacgaaagcgggcataactatccttgtacccacgcagagctcacctattttgacaaatagcagagatcagtttccttgtacggactcgctcactgttcgtgcttcgtttcgttgtttttttaggggtgtttgtggagcgggagctggacacacagcgctactacgctacgacccctcgctgaacattaaatagaatttcagggttttctccacgcgaaatccctgtcccaaaacagtggtagcacgtaccaccatgcacttcaaacacaacagcaaaaatggcctttgggcttggggtggtatgcgtatgatgcacttttgcatgattgcccacccgagctctaaatttttttgctgagagcgaggaatagtagcagaccaaacggtcttaggtctcctgtcattgtgatcccttttcatgattagatttcctgtactttctcctcctgttgcagggaaaaggaaaacgatgaagagactggagaggggaagaagaagaagagaacaccacctcccgtttcccgatgccccccctgacgcgcagaatgatgcaccgtctccgaatggaaacgccacggggccccacctgccagcttgacccctgctgctgctgctgcactgcacatgttattccccctccgcctccggtgtcacgcacgcacgcgacgcgacgcgatgccgaggcgtccgtaccaccaccgccagcatcagcggccgtcagctcgagatcggacggcacgggacagatggcagcaggcgtcacgctggcgtgtgccgcccccccgccgctaagggccccacgtgccagcgatggaggcaggcgccgtggggtggtcaaagggggcgcggggacggacacgtgtcggtcgccgcaacgtctgaatgttcgaccggtgcgcggcggtttgacccacgtgaccggctaccgccggtgcacgccgctgactcagcgcacccgtgaccgtggaccgtgttcccacacacacacccccaccgtttactgtagcggttgcaattatcagtacggccacctacaggggctaatcactgttctgacagtctcgccgagatctaagcaagggattattttgagattagaagaaggaagaaaaaccaaacaagctaagccaaggagtgggcgtctcatttggggcataaataatcaacttgttcctctcaaaaaaagctgaaatcaatttaatcgaaaagcaaaccaaaagtgtgagagaaaaaaaaatcctctcacccaaccatcctctcctccatccctctatctatctatatccatctctctcccttgcctcatcaccctagttatagctaagctaatagcctctcacacctctcgctctctcactacccctccactaccatactagtagcatccataaatcccttggctcttgcacgcttgcttcctcctctgtccatctccatctcgatcctggaagcgcgagagagagagggtgcgtgcgtgcgtgcgtgctagagccaagaaccacgagcacggccagcgtcggcgagaggcggcggtggatccggctatgtcgggcgagtaccagttccaggacgagctggcgccgctgttcgcgcggccggggggcggcgcgggggagatgcagatgctgccgtcgtcgtggttcgccgactacctgcaggcggggacgccgatgcagatggactacgacctgatgtgccgcgcgctggagctgccggtcggggaggacgtcaagagggaggtcggggtggtggacgtcgtcgcggccggcggcggcggggcgccgccgctgacgccgaacacgacgtcgtcgatgtcgacgtcgtcgagcgagggggttggtggaggaggtggaggcggcgccggcgccggcgccggggaggaggagtcgccggcaaggtgcaagaaggaggaggatgagaacaaagaggaaggcaagggagaagaagatgaaggacacaagaacaagaaagggtgagttaggtcacttcaccattaaattctctcctttttttctccttttttcccttgaaatcttgggtcattttgccaagttcttgatcttagttgctaataattcattaggatgagatcatttagagcttcttttttttgctgatccggtatcaagatttggggccggttttctgtgggctagattttgcttccttgctttgcttggtggtcattctttctttcttccattcattcattcattcattcattcttctattcctcctctttttgttcttttattcctttttaaggtagtttggcaaacgtgtgaacatatctagggtttcacactcagcttgcatgcctcacacactttcttccaaaaaatttaaaaccttgccataatgttttattaaaataagtcgtttaatgtatcagctagcccctctgatctttgttttgcttttcttgattacctgcctgctactgctagttccttcattcttcacaccttcttccaagttccaacatgaccaaagatctttgtaacttttgtctttgatccccttttaccaaagattatgcccaaaaagggtagataggaataaaagaaaagcaaagtagattgatccctagacaataagcatgccagtgttatccaccaccccattctgctacttggatcttgccagcagcttccttttcagtgcaatctccagctaccaacagtagaatccagtgtgagccgaaaaggggacgccatcacgagaaagctaggccagtgccactgtgccagacagggtgtgaaccccctaaccttgtgtacacacacgctcgcgtagtcgcgtgtgtctatccagtttgaacgggatcgatcccggccgtggccgtcgcttgccggacgacatacgaaattccgccgcttttgacgcggagaaacgtaccgatcgatcgcgagctgattggtaatatggtatggattggatgggtgcaggtcggcggcgaagggagggaaggcggggaagggggagaagcgggcgaggcagccgcggttcgcgttcatgaccaagagcgaggtcgaccacctcgaggacggctaccggtggcgcaagtacggccagaaggccgtcaagaacagcccataccccaggtacgtatgtacagttacacacacgtatagtacgtgactcgtagctgtgcgcgtgtacgtgtaccggccgcagtagttgcaccggacgcgcgcgcgcgcggcagaatgcgatgattgcaatgatctgatatatacggggttgatttttttgcaggagctactacaggtgcacgacgcagaagtgcccggtgaagaagcgggtggagcggtcgtaccaggacccggcggtggtgatcaccacgtacgagggcaagcacacgcaccccatcccggccacgctccgcggcagcacgcacctgctcgccgcgcacgcgcaggcggccgcggcggcggcggccgcgcaccagctgcaccaccaccacggccaccacggacaccacggcatggcgccgccgttgccgctgggctccggcgccgccgcgcagttcggccggtcgtccggcatcgacgtgctgagcagcttcctgccgcgcgccgccgccgcccaccacggcatgactacgatgggcggcgccgcggcgacgacgacgacgagccatggccttaacagtgcaatcagcggcggaggcggcgtctcgagcgagacgacgagcgcggtcaccgtcgccgcctcggctcagccgtcgtcaccggcggcgctccagatgcagcacttcatggcgcaagacttgggcctcctgcaggacatgctgctgccgtccttcatccacggcaccaaccagccttgacgcgacgaccaccatcaatctgaagctgaattaatcatcagactagctagacaagaggtcatttggctctcgatcgatcatgctgtttaattaattaacatctcgttacatctttttccccccaaatgatcaccttctgtttcgtttcttgattttgtttttttctttcgtgctgcgagatggtacagggttttctactgggtctcgtatcatttctatgctcttactagctagctctacctagctctagtactaagcacttcttgtacatgtaagcgcctaattaattcccaggctccagcattgcaccctgcaggttgcaggactgaccatacgagccatgataattttatgcaaactttacattgatcttctcctatatagctccattaatggaagagtacgagtacttcatatatatgcacatatgtttaattggcatgttgttaattaactctagctagctagaccaatcgagctaaggtttcttgcagggtggtcaatcatgaatgaattgaattttgaatggcgttgattagtttctctgatactggctttcgcttgtcatgacgggatgatgattaattgggggttcgttgtttcgtttggttggtaggaagagttgttaaggaagaaaagtagcgagggttgttttgctgcttgtttctttgcgagtactggtcaggtcgttccaaggctagtactagtaccactactactagcattacgactgatgcatagtgatgtaaacctgcctagctagcgaccgtgcatcgctgtgtgcatgtcattgtgcgtgtatgtgattgatatgtggaattaagagctttggggcctgattagctagcttgtgcatgtttgcttacatttatatatgggttctaagtatcagagataatcatgcattatatatattcatgggtgtcgcagtcatgcatgtttgtcagaattatggcaaagagatgatcgatgcacctaatctctaactctaaaacgtggctgctgaggcgttaggggttttggacccctctgcctcttacagtgcattgatgatgtgactcatgtactaacaaaggtagtagatctaaaagcaagtcaattaatgtgtctaactggtttgctatttcgtcggctacctgattgacaatttccagaatttggttccatgcgagatcgatcaaggggccagcgtgtgtatagactggtcatacacatccagctgcatgaaatataaaagatgtagtacagtatttgttttatttgggtgtacatgcatggagtaggtcagttagatatgatgacacatgacatttcagtggaaatggacatccttttttttaattttgtttttcctttccaatgctaagctagctatcccc

SEQ ID NO: 861 - DNA, 2814 bp, Oryza sativa
tattcgtgtcgtggtggtgttgttggcccggtggcgatcggtctcgcatagcgatggccggttcggtgcttggcttccctctctgtagcgtgtgtttgggcggttggcatatggttcggggcgtgtgctctagtgcacatctttcctcgacagccagctgtcgatgtaaaacttttcttcctatcttaattacattgaaaaaaaaaagtatgttcaggttatcgttggtaacaaccacaaataatatcataggaaaaagtgcagatactatgtacaccagaaagtacgatcgccaccagaacttgactgaacccagaatacagtgtgtgcaaaaggaacctccacttgaacataaaattggctatatgctgaagttggatagctgataggccaatagtctgccaagaacaaaatgcagggagaatctatggattgtaaaccacagagatttataaatcaaagaaccaaacagcagatatggaagtgataaaggaaacaagataaaggcaggattgcaggaaaaatatatggtcttgtagaccacagatcagaatcaagcgatgaacagcaaatcttaaatgagtaaaaagcgccagatgccagataaattgatttatttttaaagaaactacgttaggctgtgcagtcaggttagttgcagcggtgaaccaaatataaaacaagaacccatatcaatttgagatctcttacttggacgtttagtattttatcagaggatttcagtacttaacaaaccttgggaataaagtttgaaaaccagctcacttctctgtgcagtaatcctgaaataattcttgataaaatgttaaaaatgcattctgtccacctcaatacaatgtataacccgttacaaatgtaaaagcaataagtaggaaactggctaccataatgagaaggataagaatgacagagaggaaagataaatagagcggaccccaaagtgcacaagtaggctaagaagcgaagtgggaatcgaattcaatcatgaagaacgagatagcaacatttaggaagatagagtacatggctttgtctcttgctaaatagtcatattgatggctacacacatcagtagcttatggctacaattttccattgtatgctatataagttcatgaaactagtacatgccacttcaaaccatccataaactgaagcaccaatacactcacaacaaaagctcatctcatcagaagaaacacaccatgatcaatcctaagaggctagttcacctggcaaagaagtggcaacatatggcagctcttgggaggcggaggctgacgataacgggagcaactaaagaaggcaacctacgctgctcatcagccatcgcagataagggccactgcatcatctatacagctgatggagagcgatttggggttccattgacatatctgagtacaactgtgtttggcgaactcctaaggttgtctgaggatgaatttggattcacaggtgaggaaaagatcacacttccttgtgaggcagcagtgatggagtatgtgatgtgcttgcttaggagaaagccctcggaagaggtggaacaggctgttgtgagctctgtcgtaatgccatgtaattacaagagtagcactagcatggtttcagtcaatcttagccagtcactagctatattttagctactgagaagcactgtcttcatgatgtgtgctcctttttggtaaatcttaatgaaatctagtgtgtaaatagatgtatataccccagtaaacaagtaaagaaatgtagttttgcagttggttcaatattccagtattgattttacttaagcaacattccactattgataatttggagcaacaatgaggctattgtacagacatgaactacttggtcggatcaatccagggttcaagatcctattgtaccagcgcgtagtaaatattttagcaaggttctaaacaacttttatagttttccctcttaaattactccagtgaaggtgagcaatcctatgctactgagacttgagagacatggaaaatgctgaaaaaaacaccatgggtcacctcaggaattatccccctcttaaaatgactgaaatgagaagtagttcactcttcattcaaacacatcatatgacaatatacacatgaagatatacctttttcattaaaaacactccttattgatgtcacagaaaaagtttccaaatgtaagatcatgttttacaatatgtgaaaccaatgtaaggcctgaaaattgagaatacgttttacctcatatagtaacttacaagtgacagcggtaaatcatgggagctttcagctgacgtatttaaagatttaagattccctgaatggctgaatataactgcaggcataattttctctcacttatccaatggtccctgactccacagaaagaattcaaaattagattccataaaaagcgcttcccactagactccacagaaagtactacatagacaggacctagtaagctactatgaaactaccaataataaacataacaggagtaatgcgatcattatcctctactcaggtgaagagattagaggtatccaagtgtaccactaaacatccacacatccatgcacaggacagtatttacaccatggcaggtacaatccttgatatgcttcagtttcagggcaagtcaagagttgactcgttgagcttcatcctctgtaatactctctccgtcccaaaatataacaatttttagcacttaggatttgtcccaaaatataacaacttctccaccaacattcccttcccaaccaaccacaacccaccaccattcact

SEQ ID NO: 862 - DNA, 9060 bp, Oryza sativa; identical to SEQ ID NO: 462

SEQ ID NO: 863 - DNA, 7379 bp, Oryza sativa; identical to SEQ ID NO: 286

SEQ ID NO: 864 - DNA, 8377 bp, Oryza sativa
tactccatctgtaaaaaaaaaaaccactaacttagttaaacctatttgatgtgattgattttttttaacgaagtgaggagggtgtttgggaaacagagacttattccaagtctctgtcacatcgaatgtttggatactaatttagagtattaaacatactgtaattataaaacccattccataaccttggactaattcgcgagacgaatcttttgagtctaattacgccatgatttgacaatgtgatgctacagtaaacttttcataattatggattaattaggcttaaaaaattcgtctcgcatattagctcttatttatgaaattagttttttttattagtctatatttaatactctaaattagcgtcaaacatccgatatgacatggactaaaaagttttagcctcacctaaacaccccttaattcttaaaattttaagctcttcgaaatagttccgaaggctcttgaacccagaactatgtgacttttcaaaatgtcaaaagttgcaggggcaatggcgtggagggagggtacactagtccctgcgtccccaggggatgtttagatatacagttgtaaagttttagcgtgtcacatcggatattgtattatggtgttgtatgggttgttcgggctctaataaagaaactaattacataatccgtcaataaaccgcgagatgaatttattaaacctaattaatccatcattagcaaatgtttactgtagtatcacattatcaaatcatagagcaattaggcttaaaattttcgtttcacaaattagtcgtaatatgtacaattaaatttttttctaaacctatatttaaaactttatagagatgttcaaacgttcgatatgatatggtgaaaatttttaagttgagatctagacggggcctgagtcctaaccacctcgtggcggacacctgcctccgtccctgtggctccaccacttgaaagcctttgccataaaaagtaggagtcgtcctactcctacccctacccctacccctgctgcagtgctataggctagccctacctccctgctcctgtttcctctctttctctctcgcctccttcgcttcgcttccattggtggtggtctccattgctcccttcctccctgcctttttcttccataagtagtagtagtagcgggagtggccgccgccgcagccatagatctgcggcgccgcgtatctcgcggctggtttggctggtgcggttagcggctagggttttggttgtttcgtctgatcgatcctccccgattttgcggcggcggtggtgaattggtgtgtgatctgatatggctggcggcggcggtggcgggggaaggggggagggggaggggagggcggcgacggggaagagggagaggatagcaatacggaggatcgacaacctggcggcgaggcaggtgaccttctcgaagcggaggagggggctgttcaagaaggccgaggagctctccatcctctgcgacgccgaggtcgggctcgtcgtcttctccgccaccggcaagctcttccaattcgccagcaccaggtatgcatgtatatacagttatacacacaccaacacatatatgcttctctcttcctcgccggcgtctccttcgctcgctcgcagttatttctgtttaatttgcttgcaattaaatctcgatctgggtgatgatctctctgtcggttcttggaatatcgtactattgttagggctctttgtcgatcgatcagggtttcttttttcttctgaaatttccctaattgatttgccggtaagttacgttcttcattttggcgtgtttaattagtataaaatttatcataataaacataaaattctagtttatcgtgcttctaattgagttgttcagttgaggagttgagattgaggtcatggctttccaatttcggattttcggtcagctcttttttcttggatatactccatatacacaacagtgatagatgtgtatattttttctcatcatcggctctttcaatcttaaaacagttttgtctttggtttatatagaattcgctagtgtgtgtactgtgtaaaattctttcaatcctacaacagttttgtctttgtcttttgctttctctgattctacaaaatgcttttgattgttcggcgctttgattcattttcttctagatgagtaatgtaatatgttcttctagggaatgttctttaattcccaggaaaaaaatgtcccagcttcttaaatagagctctctgtatatgatgttattaattatagctccatagtgcgcttaatttgaaatattgtttagcacttatgtcgtgttctcttctatctttcactcgacccattttttataatgaaaatggttaatttacaccgataggcacacggctatatatatataagcatatatagttttttttttcactcttgaagtcagcaatcttattcagttaatttaagaccgtatggaagagactcggcagagaggggtgttttctctcttttggactggatgaccagagataaatagcagattttcttgggaaaaaaaaactaaagtaggacaggttttgcatgcatgtgtgaaagcactcgtggaaaacttaccctgttctcgcatgatttgatgtgtagttgttatacatatagataaccatatctacattattgcttctggttggatcttctcataaaactgcatctttctccatctttttctacaagctcagtggacttccaagtatcttctctgctaatttcttgacactgccgttctttccacgtttgttacattattgcttttgacatcactattttaattaattagatcttgtagacaacaccctggacgcttatcaggaaacagactatatatcgttcaaagttttttgttgaaattttaactcgtaaaaaccatctggttttagttaatctcatcgatattattttcttcattaaagcaggaataagaaggcatgtagtttgtacatgcatatatatactgaaattaattattacagctttcagagatcagcagcagatttgtcatgacaattacatattcttcatgcatgagtaatatatatatatatatatatatatatatatatattcaattctgttgcttttgtcacgaatagttgttagttttaaccgagcgtgcttaaactgaccattatttttaagcaacttcaaaataaaaaggtttaagtccaactcattcataaattatttttttattacaaatctaatggtataactttgatgctaaatactaactagatttcttaaaaatattgttggtcaaacatagctaggcaactcaatgaaaactaacaactatttaattcaaattatttttaatggatatggtatatatcggtatacagtctaattaatttgtcaactgaacttgggttactgatggttctaaccattgtgtatacatatatgcaaacaaatttagtcctaattatatgtcgtaacatgagggtacgtactgtgttgatcgttttgtgttatgaactaatcacatggaaagaagtgcatatatatatctaatgtcaagagtgttgttaactgataccccacatatatataccagaatgtttacagtgttaattaacacatggcaaaatcaagcaaaaatacaaccaatctaaacttgttaattgttcaatctttgtattcggggtaactaattaagctagagctgtcaaacgaaacgacctctgatagtagcacacatatatgggattctccaaagtgataggtttgcgactgttaattgtttgttttttttttctccacaagcgacgacagaaaactagctagtcgatctattcttttcatgtacatcacttacactatttgccagtgcatgacatgatctatcagcatgcatggatatagagtgtgcataccaattggcctggtagctagaaaaagattgaccaatccaatcaaatggatccctgagcttacgtaccgctatcagagtttgtccaaatatattttcaattataatatataaaaatataagtagatatttaattttattaaagtactttttaaaactaatctatgttccagtgtttttttaagctaaatatttaaaattgttaaagttctagtcaaacatgataattatggaattagaaggagtacgtacataagagcaagtataataaaactcaagatcgtgcttataagactcaagtgttgtcttttaacagtgttatgttgcatttggtgatgagtgtggggtaagtgaggagagagagaacgaacaatctctcagtataaaaagcagcctctacataatttaaaaagtgcaaatactagtgtgatagtaaacaaataaataacattagagtttgtgtattatggatgagatatattgtactacctttgtctctaaatacaaaagattttgcttatgtagatatatatatgggcaaaatctcttaagatgaaggtagtacacatgttttatatatatatatacacctcctgatcgaatcgatgaggagatatgagggataaaattaaaggcggtagacatctctattattaaacttggctagcactactactagtctacatgtataaacatgaaaccattaatcacacacacagagagataaaagaaaaaaaacaagaaaacaacagaaatgactgcttaaatggagcatatatagaaaaaacataatataattattggaagatagatagatgcaaagaatattttctaaaagattggacctcaagttaaaagttctctaatatccctatgattcgagccaaccataaggaatttcataggaatttggaatgactattccttcgttccgattagacatatatatagggttttctcaactttataaaatttatttaaatttcctttgtttgaaaagagccataagatatagtactagttcatcatgtcataatacataacaagaaccataagatatagtcatgtgtcttcgtcttctagacttctactattcctgctgcctgtgccatgtcatgcatgcatggtccatgcatgaaatattgatggccacagaacaagctacgcgtggcttacctcttcacagaagcaattgtattttcttcttctcgttctctgaaacaatcaatatggtagttcagaacattcatatccttccaatatggtagttcagaagcaattgtattttgaagggcctagaagaactacctaacaatatttggtactactagcatcttgatgaaaacgtttggattcaacattacaaaccttagctagctctacaaacatccaactctgtctaactttgttttctatatatacattgatgaagcatggaacagattattgaccggtacaactcgcattccaagacacttcagagagcagaaccttctcaactcgacttacaagtaagctgaaaatactttcacttgtattacaaaagagaaatgcaacagctatatgtgatgttgatgatcgatataccctctcatatcactcaactttctagaaagaattagtgtggaccttaattaattagtcagttcttaagaaactgttgctagtggtacttctctgaacatttcatatcgtttatcatcatacaagcaagaaatagtacatgtatccctaactgcatttattcatgtcatctggtagggggaggacagcagtacttgtgccagactaaaggaggagcttgcagaaactagccttaggctgaggtacatacttataactatatatagactttgttcgggagctggagattctgagaagcggctagtagcgagctgctgagaaaactggacttcctataactacatattcttagagaatctgagaatctgaaatgaactgcttggggaggtggagattacgtgaaaactatatatatacagctgtaaaaactccccatacaggacctatatacagttactgagtactattacttttcagagagaaattaaatgctacataagattacactatttcaagagttgtaggtactgtctaattctgtggattcacaggatggttcagctagtatatgtggccattaattcccttgtgtgttcctgcaggcagatgagaggagaggagctgcacaggctgaatgtggaacagctgcaggagctagagaagagcctcgagtccggtctaggctctgttctcaagaccaaggtacgcgcagcaacatgagactgtccattggacgtacgtagttgcaatgttgcacaccgtgatctttgatcatgttcttcttcagagcaagaaaattctggatgagatcgatggactggaacgaaaggtaagagcatgatattttggccaatctccagcttcagtacacagctacagagcgaaactgaaatgcagctgaaattaattatcttctgttagatcttgatttctctttctcatcacaaaactgctccatttgtgtgatcaaacagaggatgcaattgatagaggagaatttaaggctgaaggagcaagtaagtacccttaattttatctgccctgtcgaaactcgacagaggctcggagatgtgaaccattttccattatctaaaaagaaaactttctctctatgcttgctctgctcgttcatttgattaaacgacgatctgaagctgcaggtgtccaggatgtcaagaatggaggagatgcagcctgggcctgattcagaaatcgtgtacgaggaagggcagtcgtctgaatctgtcaccaatgcttcttacccgcgacctccacccgacaacgactacagctctgatacatctctcaggctcgggtgagttctcccatactttcagttccaactcctacctgaatttatgtgtcaagaaacaacagaggttagttcgatgatgaacattcaggttcagatgatgagttgtttactgattgattttgcatgtggcaggttgtcactcttcagctccaagtgatggctggaaactaaaactgagaggaaacagctggatggcatgcctgcatcgccaaatgatcagtgcatgcactgcaagactgcaacaaataacacagttttagattgccagatgatgatgtgtgtgtgctgagagtcactggctattatcgtacacataataacaatagaacgaacaagttcttctgttcttggatgttacctgaattctactcccatacatgttgtcaatggctctgtaatcgagtgtctgcaattccagctgaaagcaaccgattacagggaaataagctattttttcttaaagttctagctagcttggtacagttcataagccgtagaaaaacaaaggcaaataggacaatatatcaaaagtcatttttaggtaaagcttttatatctccattcttaccggtttgaaagcaaagtctgcaaaataagactacgatgaatgtcaccaagggaggaaaatccacaagcgaagcatatcgcatctaactttcaggctaatctgcatgcattatacaaagagcgatttttttgggaactaatgaattgacatgcatcgtccattaaaatagaggcctgcatgctttgggcgggcaagatatgttccattgcgtcatatggattggactaaaagtgagatgtcagctttagaatcttgagctggaaacgcattatctgacagttgaatgtgcaaaggttggagcaaactcatctcgtccaccgggaagacgataaaatgcgtccagatctcgctcatgtacataaaaatttcagattgcgaaattatccccagggttaaaagttagcactagtaaagtacttttagtttagggcaatgatgcacaagcctttagcgtgcactggatcggaaaatcagtaaagctttcagttttgttgattctggctgtcagattaaacaatgcaagtagtactgagatgaaaaaaaaagttaactttagccctgcttcgattttctttggccttttcaaattttaatctttctgaagaagttagtgtaggttagcagaatggcagagcagaggaatgttctagtagagcggaaattcagtaaaaaattcagttttgttgaatgtgactatcagattaaacatgtagccatcagtactgaggtaaaaaagttagctttagcctgcttcgattttctttagcctttgcaagttttaagctactgaagaagttagggcatgcatggttagcagaacggcagagcagagcagatgaatgcaggatgatgcagaggagagccagggccgaaatgtttcaaacttcttaatttattccataaccagatgctacatcggacggcagcgacccgcgaccgcgggtcaccggaggcgaagaagatgaagatgaagatggagatggag

SEQ ID NO: 865 - DNA, 12908 bp, Oryza sativa
tcatacactagttacttactatactagtaatatctggtcttacctgtcatacacacattatgtcttttaaatccgtgttgtagctggctacagatctgtagcccgctgcttttctctctcttcctttatctctttaaaatatgtttatagctggcttatagcctgctatttgtacctgctctaaaaccgaatacatatttcctccctcccaaaatatagctatttttaaggttagtgtgggtattaagaaaaagtaggtgagaatgatcggactggatgaagtgtgtcattggttgaaaagagaaagtaggtgaataagaatgattgtgattggttaagaggaggtaagtagagaaatagcttcattttagaacattgtgctagaaatagttaaattttgagatggaggcagtatctatctatttattgcgtataaactaaataattagaaaaaaaataattaataagataaattaatttgtaatatattcatttacaagcattcaacttcaaattcaacttatatttttatataagttgtaaaaaataacaaattaactctaatcagtatacatatatttacaactaaatttattttttacaacttgcaaaagttaaatttaatctcaaatgcttctagtgtgatatatttcatattaatctatcttaacatttaccagttgatttgtgataaacggttagcaacaattatccaggtgattagaatccttctctcccctttgcagcactgttccccccactccccctttccttatcaggaagccacacgcactctccgtctccgtagactgcacgcttcgtcgtcacatttttcacggcctcctcaccgccctcccccctcgggccccacgtgtcagccgccccgtgcggattctttctttctcttctttttttaacctttttttttttctttttggtataaacaaggaccagtgtagttgcgcccaatcggaggggagagaagaggagacacacgcaccgcacggtggtggtggctctcggctcggccagatttgtttaattattcgccccgggtttaccgcggccgccaatcggaggcgccgcgcgcggccacatccctttctttctctttcctcgcctcgcctcgcctcgccattggcgagccgcggctatatactaggcgcaccccgccgctgcggcgcgcgtttctctctctccttgtctctctgtgctgttgttgttgcgggtgaatctgcttggatttcgtcggagttttctgtcgcggaggaggagggggtggtggttgatcggaggggaggggggagggagatggcgagggagaggagggagatacggaggatagagagcgcggcggcgcggcaggtgacgttctcgaagcggcggcgggggctgttcaagaaggcggaggagctggcggtgctgtgcgacgccgacgtcgcgctcgtcgtcttctcctccaccggcaagctctcccagttcgccagctccaagtaagcgcgttctctgatcccctctctctctctactgttgatgctgctactgctcacccgatgatctcaccctttttttagttttcgatccgctcgagatttttttggggggtttagatctagctacctgctgctgtgttcctctctcgtttgaaagggctccagatcctcccggtcgctagggcttcctccctcttctacagttttacttcttcggttttagggtttgtgtttggttgatgcgatgcttctcgcgaaacgccacttcgggatcgagccttcttttctacttccagaacaatcatccttgcggtttttggggctgattcctgggtcgattccggtggattctaccacccgggatggtcctccgaaaatggggaatttttctactgtagtttcaatcacaatctccacagctaagtacggggaaaattcgatcgcttgctttttgcagatgagagatatgcatatttctcgtgtattccatttgctttcatgtggagaggaacactctaaaatccggttaattttgcttacgtacgctgctcgataaaaaataaatcccaaaaccgatcggcgcggcgcgcggccttgggcgcctccgctaatcgcggcgccgccgtacctgtgattttatgtgtggtgtggcatggcatgccgtatgcatgagccgtcaaccaaccaaccaacgaaccagctgccgatcagttcatcctctcctactgcctctctctctctcgtggtctgcgcaggtggccggctggtactttgctgtagctatagctatatatgggatcactcttgtagcctttgggtatttgggcttgctagcttaccattattggtgttctccaagagagaaaaataaacatttcaagtaccaagagggtacgtggcctttgcatgttccatatataagtatgtcgtccaagaaaaaaaagggttaatttagtatagtaggactatacgcatataagcatgcccaaagagaagggggttaattaattaatataatgatgagtagtacggtactccattttaagagtgtgatcgatcttgatcagtttctttttggcagtcgaagctatttaagaatataattgcatcatttagggattgagcgcatgcatcagagaacataattgtatgcacgttttctgaagctcctttgtttaatttctgtgtgatttttttatgtgcctatatagttgactgcatatgggtgcttctttcccaaaaataatggaactgtgcgttcttcttttggaacgtactgtccttgggtgtaacttaatatttgatgcttgtaatttacaacttgatatatagttcatgataacttgtttcgttcttataattagaaccatgccatgaactttataatagaataatctcgtgtcatttatgtgttttgtgtaactaacaatgaaggtgagaagatcaaggtcgtagtacctcataaactttacactattcctccactattccttttttagggtcctcattttatatacttttttctacttatcatttggaacatctacacagttctacaatacacctaagacgctaagaccattatctttcacaatcttatgtcccaagccgctaagtataattgtttatctattatatgcccaatatcatgctctctagtttttcttccctacaatttgtcatctcgttatttctccatcaacgtacaactccattatgtacgaggaaaagatcattccgctatgatactatttgagtgaacaattatcagacaacaattaaataggagtaacatagcatttattgaggtgaagttaattttcagaagggcaaatgttaacgaagacctggtaattaaactggtcttttcgatctccatgcccaattgcactgatcgagaacgtaaagaccttggcatagttttttttatggcacctatatattcagtatgtatttcagtaggaattattgtacaagagggacaattcatatcatcaaaacctactggtggcatttctaattttcttacatgactgaactttacacttttgtgcacatattactagattagtgccatagtttttgtaagttcaagtgcgtgctgctaaactgtatcctagttgagaacggtgggagttatattatataacttaatttttttctacaaaacgttgaacagaaatcactggacaaccttaagtcagataagaaactatgcacactgttataatttaagatcagtgattctgctgacattattactaagagcatatatgatgaagacatcaaaatgtactttaaacatgggcatgcgtattacgagtagcacataactctagcagaaatgtatgaattctacacaagctcagcatatccttggctggctggctacatcttcttggagaacatccaaagctatctttttccacccctttgaaaggatataaaatattgtgcaagtgttagtccaacgcagtttatattatgattacacaacaatcccaattcccagggtttcaaattgaagtttacttctagaattaggttccaaccattaagcaatacgtacgtagtatattctttatatatgcttatgtttttttcctgagaaaaatatgcattgtagtttagaccaatgggccagaattcatctgacaacaataaacaatatgtacttgagtggtgtctgactggtttccttcatgttaccctcttttgaatatgggattcctatagacaataacagaagaaacaaaaaaaatgcattatattagattaaattcagagtgctttagacaatcatatatagagtttaattttccattgatatatatgaacatgatatgatatgataattgaatatatatatatatatatatatatatatatatatatatatatatatatatatatatatatatgatgctcgcagaatctcttaccaattttcagcgtaactagtaacaaataattaagatttattctcttattaaagaggctgtacttgaaggtgttagactatagatggttttgtatattagatatacattattattatatcttcagagttcaaacccctttgaagtcaatttacaaaaccttgcttgaagacatgtattttatagataccgcatgtataggcagcttggtgcaaatactgattattggtatttttctttggtcaagcagtatgaacgagatcattgacaagtatactacacattcaaagaacctggggaaaacagataagcagccttctattgatctgaatgtatgtaaagcaatctctgtgttttgtagttcataatcataagtggatttgtactaactagtattagatcatatgtggtgtaatgtttcatatatttatatacatgcataagtcaacatgcaatgataacagcactttttttttctgcaaacagttctgctgactatgtttagttctttagagcaaatttaatagtatagcccactactagctccaattcatctatagtcaatctaatagccaattcatacaatagttgcttactatactactaatatgtggtcccacctatcatacacacattgcgtcttggagtccgtgctgcagctggctacagatctgtagcctgctgctcttctctctcatcttttatctcattaaaatatgtttacagctggctaatagcctgctattgtacctgctcttatagctagttgcttatgcttaattaagaaattagttacacatgtaaaggtataactttacccactcatataatgaaaatattcttaaattaattaactaggacagtagtggagggtgcagaaatcttctcacttattttttgtcttcccaaacagggattttttttaaagaaaatggttagattaagaaaaaaaatcatgctaggttattactcgatctacagttgtaacggattgcagccttagttgtaccaacttataaacgattggatcagtagcatgttgttttttttacattatatatatatatatatatatgtgtgctagtttcatttttgagtattttataggttccccatattaactcaaaagcatgatctctgcaccattaaatttttcatgagtttagagcacaacaacgatgtccacaaacttgtagaagtgcgcgcttcatatgatgatgcaagcttagagcaagtttaatagtatagcccgctactatctctaattcatatataatcaatctaatagccaattcatacaataattgcttactatattattaatatatggtcccacctgtcatgcacacattacgtcttggagtctgcgctgcagctggctatagatctgtagcccgctgctattctctctcatcttttatctcattaaaatatgtttacagctagctaatagcctgctattgtacctgctcttaatgaaaataagaccatgtaattaatgtaaatgtgagacactatttaatatcctggatctgcaaagaaaagtgacataaagtactaactccacacatttatatgtcctctaacctaggaatataaatgcaagaatctcatagaaattgtctttgtaactagccttcttcttaattatattgcttcgtacatatactaacagttatgcatatattcaccttcttcttcagttagagcacagcaagtgtagcagtttgaatgaacaactggcagaagcaagtcttcaacttaggttaattatgttctgatccatattgattttattatttcgatatatcacaaaattgtttgcaacagaaatagcccgtattataagttgataatgtcacaattccacatttatagacagatgagaggtgaggagcttgagggattgagtgtggaagagctgcagcagatggaaaagaacctcgaggcaggactgcagcgggtgctctgtacaaaggttgggtgtcatccgatggtgttcccttttcagcttcgtatgaattggcaggcacaatatcaagtttttcagacaactaatcaatatatgcttatgcaggaccagcaattcatgcaagaaatcagtgagctccaacgaaaggtaaacaaaatgattagattccactagttacttttgttaacctcgtaataatgtccttaattacattgatttcactattgtctgccaaacatgttagtctagttaagggtattttgaatcatagctagtaattctctatgggttctcaaaattctgtgtccctgtaagcagctaataagctagatcctagaggaaaaaaaaagttagtcacaacttaattaccgtcagttgtataaatttaaccgagtgaaaataggttttgtagatgttttattgtcattgttgtactgttatagatatattggtgataaagatgattattaatacaacaagacactagtacagaacccataatatgtgccagttgagaacccccataggtgttggatttttcaactggcaccctattagaggcactgatggggagaatcaaaagtgctagtataggaaccggtacctttgaggtgtcacgaataaaaaaaactaaaactggcttgatgcatcagctcgaaccaaagccgatgctttgagcgttccccatagcccccaaggtttgattgacatccaagaacaaacacacataataacatccaagaacaaggtcgtctctgagctcgattgacattagaaatcattaacatacaaactcacagaatcaacaacaataatatgaggaggttcactggagagaaggtcgccatccccgttgctgctcaccatgggtgaaggtgaaatctgcttgctcgcccaccaccatacaagccagatttgtcccccggggatctctagttctactgctcgccggcttggcagagaggaggtggctggatttggctgctcccgagcagcgaacagtaggatcaggagatggaggcgtggtgactagcgaggaactccatgaggcacggttggtgttcgcggatgatcagatctggtagaggtcaacaaggacctcaaggccattgctcgccggcttgggggagaggacacgtggccacgccgctcgttggctaagtagagaggagccagctgcgccgctcaaaggctatgggagagggcggccccactactcacgagttggggagagagaaggcagccccgtcgcttgtcggcttgggggagaggaggtggccgtgctgcccataggctaggggagaggaggcagacggccgaggggaccggcgtgtcattcgagaagagagaaggctagggagataaagatcatgaagaaaggatggtgtgttggggatggagtcagggagataagatcgagaggtacctaataaatcgaggtgggctcccacagtcccacattttgttggctcggctgcatccttaacagtgctgtgtttttgttaaaactagcaattatatccacattataagttttggtttattaaaaaattcggtacatatattttatgtatcgattgattttctttaataatctggcacctataaggggtgataggtgctggttttcaatatttaatccatgtgcgggttttgggaggataggaaatatatacctcatgtgctggttttagatgaccagcacatgagggtgtcctcaattaatggttttgtagtagtgagtgtacggcaaaaactatgcagtgtagccagttgcaagaaacttgtataaaatggcgctaaattagtggaagtttacaatatgacatacaacaatatactaattctgaagatgtcaatatgatatgctttttggagtatttctagggaggacacactgctagagaacgggtcatctctgatggttcagaaagactatcaacggcgggttgggtgagcaacccgacatttaactattggtcagtggtgagaatgacacccccgttaatgatgaaatcatatgtaacggtctacaagttgtgacccatcacagataggaaaattctgcacaaaaaaggccaaaattgccatgactatgatagggaaatttggccaaaaaaatccaaaaaggttgtgcttgtcgccacgccgccatcatttccgtgccatggctcttattgttctactatccccgtcccgcgcgcagcttcttgtcactgtactattcctgtcatcgtggtgcacggctgcttgtcgatgtcaccatcatcatcttccctcaggtggctgaatccatagttattggaactggactagaccggtggttggaccgaaaaaactagaactagagcctccgccagtttggtccagctaaaagaccgtttgcgcaattgacccggtagaaaccggttgggtcacccgtttttgtagaaaaattgctattgaactggaattgaaccaccaaggattgccttgtgcaaggtcacatgcgtcctggaggctgttggagagggaaaatgtgggaaaaagtacgcatgtgggattcgatcccacgatcacatgcatagaagcaaaccaaacgaccagcatgctacgatgcaccttgtgttttgaaagaataacctatctatttaaattgcattgatccgcttcaaaccagtggtttaactggttgaaccaataaatcatcaaaacgagagcctcactggttcaattaccagtccggtctcaataactatggttgaatctagccaccacgaggtgagagtggtcagatctaacgtccctcgaccttggggaggttggatgtagcatccctaaggcaatgtccaatgctaaagggtggaggagatagcggccagcccttggggtggagcagacggcggctaacgctcgggatctagccaacatgcacgaggttgattgtggtcaaatccggcgtcccccgaccttggggaggccactagtccatgaggtggtgcccgacgcttaaggatgaaggaggtgccagtcgacacttggggatttgggagtgagagagtggtcgtatactttgtagtagggtcatctgtggcggtccgaaaattaagcccatttgagatgatagctcatcctaaacatgtgttactaacaccgacgctgagatgtctttatcatttgtggcggttcatatgaccacacccatcacatcggggtcatcatggttgatctttatttacagttcatactttgacccattgtcccatgtagtagtatcttaaagtttttttttccagttggagatgaggtcatcaaagatgggtcactttgaccctctacagatggcccgtcaccgatgtcccattctgtagtggtgactagaagtcgagaactagctaaagggtactaatattcactattcagtgccggaactttatatatagcaaaaattattatatatagcaaaaattatattgacgagtgaaacatgtgcatgtactatattggaatgttgcttgcagacggtatacgatggcaataaatcaataatagactgtcaatgaaatgctgaggttcgataggatctctgtacgagagtcaatttttgttgtgaacttattgcacaatttttcaggcatgaaatgttttctcgacatatattggatggaaatgttatcattcagcagcttcctgtttatttatgcatagattttcagatacagtaaactttctcgtgaggcttatgaggagtattatttatttagaaattgatattttcaccgatatccaacaatgcaactaaggattacatttagaatagaattttactccctttgctcttaaatatttaatgtttaggataagattcagtcaatcttttaaaaagttgaccatcaataatttgagattctcaaatgtttagtttaaaaacaaaagaaatgatatatatggatttacctttaaaaataaccttttagatttcataaatttattctaatacaaaactgattgtcggaattacaaaattttgataaaattttgtatgaacgtaaaacatttatgtctggatataatattttgtatttatcagcacaaaacgtaaaattgatttggttggttttgaaaatgaatcaggtataatttcacaaatcttatgatacaatttatttgttcttgtagggcattcagctggcagaagagaatatgcgcctcagagaccaagtaattaatacatactgtgtatatgcgttcgaaatatttgcatagttttacaaaataaaatgcaaattcgaggaccctttggtttctccatatcaggcacggcggaatatgcatttatattctgtgcatttgcttgtatgcagatgcctcaggtgcctactgctggcttggcggttcctgatactgaaaatgttcttactgaagatggacaatcatctgaatctgtgatgactgcattaaattcgggaagctcgcaggataatgatgatggttctgatatatccctgaaactagggtgagtttccgctggaacccttgtcgcttctttgtagctaatttaaattttctcagatgggacaattttaataattctgctcgttctgttggaacatgataaaacgaaatttaaattctttctagacgattgaatacgatatcatgatcttttcccagaactcaattagtttttaatatacttaaggatttgatcttttactagctagttggtcccggcaggtaagctttccctgcagatggtatccattttcacactaaatccaaatgaaaactgcactaagggataaacgacaaagaaaatcaacttaagaactatgaattattgattgaaataatgccctttttattacttgattcgtgcccccctaaacctgagatcgatcagaactatgtactctgaatgtgttgtgttctccttcaagggtgttaagttaccaagcgaatttattttcctcatgtaacttatttctttgtgctgttcaacataagcgcaaatattggatggctgtgtttggatgtagagaccggtttaatccattctctcttaaaaaaattgatatcttcaggttgccttgaaataaaaggaccagctagagagctgagaaatgggatgacgaccaccatgaattatttgtctgtgtgcatgagtggatgaagttggaagttaaatgcatcttaagaagatcaagaagatgtcatgctatgagattaccaacaaggctgcaataatcctatcctatgttaaaaaggagatcgattgacttgtcatcctatgcctgctgatgcaatggtccggttgcttggatctttttttctcaacttgtactagtgtaccatactaccttcgtcgcacttaatttaaatgcgacatgtacgtatgtatcgttcgcttaattcgtgcaagttatgtacgtacctgtatgggaactgtatggaaacttgtgacctcggctgagacttattattggcacaattattaagctagtcattctcatcataataacttagtacttttttcgctgacgagtaatttcatttaacgttgcgagtttatggatatactgatttactccctccatcctagaatataaaaagttttaaagttggacacagttattaagaaagtaggtagaagtgagtggtggagggttgtgataggatgagtagtggagataggtgggaaaagtgaatggtggagggttgtgattagttggcgagagaattgttggtgaagaagttgttatattttaggacaaatcttaagggaaagttgttatattttgggatggagggagtactttatatgatgacatatgcttgaatccctaaattgaaattaattcgatgttagtggtttttttaagtaacgttcggttgcgtttacaatatataaaacattaacggaatgctttctcatattaaatgttttgggagagaaaataatcatggtttcttgcattgaatattttcgtagataaaagtcgtttgcctttctttgaatcgacaaaaatcatttgccttgatcatattaaagagagatgctgtgagggtgctccggccggtcatggttgcagtttttcttgtcatgtaaaaatgtcttccgttgtatgtgttgggtactccctccatttctcaatagaaggcgtaactgcattttgtcaaaatgtccaaatacacgacggcaactacttggctctcgcgtgttttatgtgcatgtagaataacagctattgattcttttgtttggctagtttaaaagcatcggctatggatccctctcgttttcttttgaatgaccaacaccagatggtatgatgattcattgaatatagcatgagaaaactataaagctagtaacctagaagacagtaaccatgaaagaaaaaaatcagtatcaccacgcaccacgcgccaacagtgcttatacaacacccaggagaagattagcaccggaccgaccactgctagaccaacaaagaagctactgccgaaccacccaaaaccaaa

SEQ ID NO: 866 - DNA, 4533 bp, Oryza sativa
tcgcatggccgtatttgccaaacgtgacgaatgctccttcttcagttagaccgagaaaaattaagctagattccataactagcatcgatcgcttatgtgagtgtgtcagctgccttgcacgagctgatcagctcgcacgcatcgcggaggattcagtcaaaaatatgatcactcgcgcatatatacatgcatttcagaaagcacggatgcgcctagctcgcaagcaacagcgccgtgcagtagccttacaccatgtaattacacttggaatctagttctaccatgtaattacacttggaatctagttctataaaaaaaagaagttggaatcgtgtttggaacgatcactctgaagtttgatccactcagatcccccggaaaaaaaaatatctccatcatttgctttgtcaacgagttacttgaaatgttgagtacactgcgcggtgcaacgtacgtaacgcaaaattacaatcccaattaagcagacgcagtccccatatattgcatggtcaaaaccaaatgaagtccaagtctccactagattaattcgggccaatattaagtatcctgctgtatgtctttcggtagaaactctgcaaattacgatcaatatttagcccgtttcaagaggaaaatagttacagataagtaggtgtgtggtacgtatacgtatatatgtgtttagttcacatcgaaattggaagtttggttaaaattgaaacgacgtgacaaaaaaagttaaaagtttatatacgtaggaaagttttgatatgatgaaaaagttgaaagtttgaagaaaaaatatttggaactaacaaggccgtaaccgaatgtcaaatttgcatcaaaccacgctcctgtagcagagacgccacgtgcagcacggccaagcgttccattcctcccgtttccacccacgcgcgaacgccacaatttcccccgttttcctgggcgtttttccaccaccaccaccaccgccgcgagacgacacgagaggagggcgcggcgacgacgcgagcttccccgcgcgcgcacacaaccgcgacgtttcccgacccctcactccaccccccaccgcaccacgcgtgcacaccaacactaatacaacactcttcttctcacttaacccgctctctcttataatcaccaacctgcagcgagctgaactgactgagaagccaatccgcgaagctaccaaaccgagccaaaattttgatcgatcgatcggccggccggtgtctttgttgaggcgtgcaaggctcgtgctttcgccgagagggattaattagccgcgcctccagcatctccggcctccatagagatcccagcttataattaaagctgtcaagagtcgttttggttgttaggcttaaagttaactactgctggctagctaggactaagagatccgagggagcagacatggctgctgctacttcgaccatgtccctgcttcctcccatcacccagcagcagcggtggcacgccgccgactccctcgtcgtcctcgcctcccgctgccacaactctcgccgccgccgccgctgccgctacgtcgtgccggtacgtacatgcaccatcctctttcttctccggtgaatcaatggttggagaagaagaatccgaatgaaatgtaaattaaatatgtatgtggatgtggtggtgcagagggcgaggctgttcgggccggcgatcttcgaggcgtcgaagctgaaggtgctgttcctgggggtggacgaggagaagcaccagcacccggggaagctgccgcggacgtacacgctgacgcacagcgacgtgacggcgaggctgacgctggcggtgtcgcacaccatcaaccgggcgcagctgcaggggtggtacaacaagctgcagcgggacgaggtggtggcggagtggaagaaggtgcagggccacatgtcgctgcacgtccactgccacatctccggcggccacgtcctcctcgacctcatcgccggcctccgctactacatcttccgcaaggagctccccgtggtacgtacgtggcccctttcctcgtcgctcgctttactgatgctctcttcttctttcagacttggagaccacaagcttttttccttttttttttcccctttgctcttttcatttttgcaatcaagacgtactctgtgtcaatgtccctgagataattgatgggatccaataattcttgtctgctaaagcaggcaaatcccttgactttctagatctgattttagacactgttattagtggcaccaaaaactgatctccaacaagtaggggaaacaattttaatctctcagattggcatccatccatctgttacatatcaattaaatcgttataaaaaaaattaaaatatttgataatatagattcacatataatatgtaagtttaaattcgacttttataagttgtaataaatataaccaatcaaactctaattagtttactatgttcactgttaaatttgttacttttattataacttgtataagtcaaatgtcaaatttaaacttatatgtttgtggtgcaatatattatatgttaatctattttatcaactttttaagaatattatatactagtgaaattaatcaactgtgttcaaagttgcatgcccacttgacacgtgccaaacacgacttggaagttcagatgtgagaataaaaatcgaaatttttgaacagcttcctgaaattgattaattcgagcctaatcgcttgctttggttgaccgttgactcggcgcgtgttcggccaggttctgaaggcgttcgtccacggcgacggcaacctgttcagccggcacccggagctggaggaggccacggtgtgggtctacttccactccaacctcccacgcttcaaccgcgtcgagtgctggggcccgctccgcgacgccggagcgccgcccgaggaagacgacgccgtcgccgccgcggcggccgaggaggcggcggcggagcagatgcccgcggccggcgagtggccgcggcggtgcccggggcagtgcgactgctgcttcccgccatacagcctcatcccctggccgcaccagcacgacgtcgccgccgccgacggccagccgcagcagtgacggcggcgccgccgcgattcgtagattagcgaattcgtttggttgccatggtacacctacacgcatgcaatgtcgccaaatgacgctgcgtgctttgcgttaaattctttaattattcgtagtggcatttagctcagctcagctcagctctgcaattagcacatatttgattagctttagggaatgagtgtggtgagcttgtaaatagaagaacactagtagatggcaagcaaatggaaacgatcgatgatgcagtagatgttactgcaaaaatggcaattattagatgaagtcgacacacaaagacagatctcgtttcatttgtacattctacagtctacgtcgatgaggacatgactggatttgtatagcaaattagtactagcagctaataagtgtggattaattatgaaacacgattgtttaattatgcgcttggcgagtcatgcgattctttttcctgaaaaaaccgaacgaaccatggtgttcatgtcgcgatcagaattcagaacatgtcaagatagctctcgaatcttgccagactctgcaggagacgtacatgaggagaactgaactgaagaagtcgttgcaaggttggtaatctggcatgggtaaaaaatacgtgtgctctgaagcaaatacgtcaacggtagctttcaggcttgcgtgccggcttaattttgatgaagctgatcgatcgatcaccgcatgagttgatggattgaggtggtgtttgtatcagaaacttaactttagtctttttatttagacactaatttaaagtattaaatatagactacttacaaaactaattcaataaatgaaagctaatttatgagacaaattttttaaacctaattaatctataattagagaatgtttactgtagcatcacataggctaatcatggattaattatgctcaatagattcgtctcgtgaattagtccaagattatggatgggttttattaatagtctacatttaatatttataattagtgtccaaacatccgatgtgatatggaattaaaagtttaagttccatctaaatagggcctgaatgaaatggtttgagagataactttcggttttaattgcgtcattgctggaatctgcaactttgtctgcaaccgtgatgtggtgtatgatttctatggtgtgcttgatgatgcgtgtaactcttgcggtcttgcctctttctagtactgctataaaatgactcttatgctctctgtttttttccatcttttttctgaaagtaacctatggtggctctgtggtttcacatttaactagctttgttatacaccaaaaatatcgattgaccgagatagatatgcttggtacttctttataaagtgtttttgaatttaaattagtttcatgcttaagaatcattttaggtgaatttttacttgtcctcttagga

SEQ ID NO: 867 - DNA, 13065 bp, Oryza sativa
acaccataaatcttcttcaaccaccagcacttgaaccagaaagtaacagtaaaagaacaccagaaatcattgatatcaacgagctcgcaagccagcatgaagaaaatcagagatgctagacataaccgaacattgtcaacgatccaagtcaaatcctgaacacctaaattgtcaacaccctacaaaaacccttcctagatcgaaacactgggtagcaatgcgcatcaaatcaaccctgatcatgcagaaaaaaagattttctcatagcagactatacaacaacccgcacaagctataatttgaaatgaacaaccaaaccccccaccgcatcaggccaagctttcccactattaatccccacaaatcaaaccaattcgcacaagtagcaacacgtgataagcatgaacaggtaacatggatagatcacacttacgagcgccatctcgccctagccgccgcctagctccactcaatcgatctcgatgatctcagatctgcacgtcatgaggaaaccacaaaattttacatatgtatcaaagaactccgcaaaaacaagattcgcaacaagcaataatcgcgcgagcacaatagctgttgcaaatcggggagatcttaccgtcgaggaggcgaggcgagcagcgggagaagcaagacgaaaccctagtggaagtagcagcagccgacgagggattcggcgccgcctacttatggaggcggcggcgcccgcctcgcaatctcgcctagggttgccgcgcgagtgatcctgaccgtccgatgagggatcgaacggcgcagatcaggctcggcatctccgtagccgaggccattcgtctgggcctcttcagtcgagcctgttgggctgtaacgggcctcatgccttcgctttatatgttgggctgaaatgggccttagtcctttcttgttgggccttccagtcgtaacgatcctttattttttttcttttctgcttttttttttgtgctgattagtttattattattgcttctcccacggcgtcgggttgggctgtgctctctgggcgcggcgacgcggcggcgcggcggcgtcgccggcggcgggcggagatgagttgttgcaggtatacgcggccttctcatcgtcttccgctcctagaccctgggtttttgtgttggctggtgagatggaagcgctggcgtgatttgccctgcgacgctgcgtcgtcgctcaccacatgttcggcgaaatgcgcccccggccaagatttgtggtctggtacctttcttgcgtgtggcgacgctgggtgttgagctatatgagcttgtagaggtttctgtgcgtccctgatcttgggttcggctgtggatgtggtggtcggagaagcatccggcggtgccttagttagtgcagaaaattcggcgtttctttcggcatttttaccatttacggcttatttgcaccggtataaagttagggatcatgattttagtcaaggtctcactggcattgtggtttggtcctggccatatgtgcttaagtaactggattggagcgatatgactgttgattaaaagatagtgacagtttgcttatgatgcctcttaatagtttttatagtatcatattctatatttgacgggtccaagtgccaaatgagaccaacagagacggtagagatataccttgcctagtgactgtttctaccacaatatatggtggcggtgggtgcaactggaaactggacacaatggttgttctttattcttagattgatgtagtttcattcatgtattctcttgtgccttgctgcaatattcgtaagcatcagcatattgtgtcgtattaaggacgtcgcataattctgatttctgaaagctaagtgcgctctgccgcgctttcaagttgaagttttatgtgtttgtgaagattttgagagggaaggccaaatctttctttcttttttttgcaagtattatagtaaaaaaagttggacctacagtgagatgaaaatcaatcttaacttcacctgtagtgtataccttgaactacaggtaaggcttgtgtcaaaattatttagattctttcaggtcactagttttaatctgatgcaatagttcaagcatgttttccgtacctttgattcaaccatattttttgttaaatactttaagaaatgtggctctatgtgttaagattagattattgtttgtctatctgaactcagagaagtctgcagctgctgtaccataagcttaaatagctgttaaccaatacaaaccctttcgtgtgacatttttctttagatatatgtaggctgcacctttattgaacatacaaaaaggatctagatgggtcattctcatagcttagaataacatctaattaaaagcttataactctgcgtgtaggatcaaacagcctgagcaagttccgtcaagtgaaagcggcttgtgcagctttgttcctaatgttgaaatgttaagggaggaaggtggggggggggggggtatgtgtatattctttacagaaaaataggaacataagacctctgccttggaatctggtagtcactagtacagatccttccatctgtgacggcccctaacatgcctggaattagcaggccgtcacaaggaagtaatctcaatcgggccgaagtttcacccgattgagatatggtcgcacagacatgctagtgttcatgtctgctttaaacaaaaaacaaaaaagaagcaccaaaatagaacactttatagattacctggcatcagaaaatatacttatacaatatacacttactatcatcacattcatatgttaagaaatccgtacccagacgattctccccatcctatccattagctagtccattgtcttgacttgtcaatgtcatatgtttcttttcaaactttcctggatacacctttattttgttgttgcatggtacaaacattcacaattatttttgagacatgattgcaagatttaagcatgagagagaaagtacatgtagttgctgcatacgctgtgttgttttctttcttcatataaatgaaattcaatgatgtgatggaaacatagcgagaggtagcacatcaggaatgttctcccagctgagctctgaacataatccatccattcaactatttgcatatggcatgttattttttttatgctttcttagttattatgtaaactattatagcttaatttacaaaaaaaaaattagaggtggaaattttaatggtgaggcatcacattagagttccaggaacgtgcagtgaaccaaaaaaaattggtgcctcaacagatcaaatcttatgattgttctgatattgtgtgcttctgttgtatcaaagtaggagacttacaaaataagtgggaacaatattatagggcctgtttgggggagcttaagattctaataagcagctgattagtatccagcttctgagaatctggaaaagctgggtttcccagcttctggcttctagttcatttcctggattctacaactacagtttctcagaatttggaccaaaagctggactgtttaggggagcttatgattctgggagaagctataacaactagaagcttccccaaacaagcccatagtttccatccttgatttggtaaaccctcatttccctttttacccctagttttgaaaaattacctggtgcatcattcactcgtagcataatctcaaaatcatgtggagtgacattaagccgaaaaataagtggttgtggctcagcccttcatcacacccctaggttaccttatccaattcctctcaattagtgtattctttgttttctgtctttttgttgtttctttaatagcaacggctcgttatggctgtgtgctgcgcagagccacttattgcattgcttggtaatcacatatttgtcttattatattatcataggtatacttttaaaaaattaaatcaaattatgatcatatctgaactattccatctcttattttttgtactattgtgattcattgatttacatgtttactagcagttactacatttctgatattattcctgtaagtgtcattgcaggcctcctttttcttgatgataaacttggtattgcctactcctagaagatgtttgacaattggagactgcagcgcaacttttctcaaatatctaggcctttctttgtcctaatgaagagaagtttgcaagattggaaaaaagaagtgattcttggcaatgcctgttgtgtatagaacattttattcacttgggtgccactgataagcctaattcaccatgaacacctctcagttgggtttttgtactttagcctgcactctggtatgaacacctcagcttcttcactcaagattactatttagattttattttctgactcctttttatttccctttcctcatttctacccctggttttaccatgattctgttaactgagtatttagagctaacagagaatcattttttgctggagtatttgggaacattttatgtttagcaacagtacatcttctgatattcttcatgaaattcattgctagactggcagcaacccttcaaagctgaacactgtagcgttctgttttctttcttattatttagtaatgatgaagtgcatgtatatacataaaccctctcatttgtgtgtatcatgatcccacacacacatgagggtccacgtaggcatggagcgtattgtgtctttttgcacaaagccatgatcccgttggatttgcaagagccttgtgaaagctacatttttgttggccacaagtctatcattgagctgggcaccttacatcttgtgacagtgagtgaatttattctcacagacactcttgctcaaggagtgattcaaaaggctcatacgtatacatcttaaccatcatacaaactagaagctggctgtctatcaaagtgaacattatccagctatacgagtggtacgataagaatttggtagtgtggcctgaagttttcatgtaattatctgtgaacatatatatacggcctctctctagtaccgtattagcgaaaagctgtcgtttggctacatgctatttttaacttttattttgtggcatacttttccaatatttcaccggacatcttgagcgagacagaagtatcttatggtgttgtgtgatgttttgaggataaccagtcattttctagtagatctattctatagctgagatctctttcttgcttccgttacgtttggagaatatagcatgcatgtcttaacagaaacacgctcttacattattgctactactgtagcttaagcacatggactgtcagcataagtaaacgaatgatgtcacagctgcagcctttaccataagagtttgatccttcagtagatgttaaatttagatatatggagtagatgttaaatttagattcaatctccttcagtattgctcaagcacttcgaatgatattgcatcatgcataacaaaatggctcattacacaatgatgaggcaaggacagtactgtttgcggtagtatgggggatcatttggtcacttcttgagataagattgtgacaaattcatttagatgcttaattattgataacatataccaccttatcaatctcaaatttctgtgctgacttatagctgcactcttcttgcagtatctttatttatgcaggagggattactccggataaatcataaagggtctagatccaatgtcacgaagacaacttctgcattctgtctgaggatatgacgattcacaactgaaccatgcctgacagattattgcgcaaaccgaggcgaaaagttcagtgcagagatctgctcgtcatttcgtcgagatggtacaaacccaggtgctagcttctccaaaataccaaaagagctccagtcccagctctctcctacttcatcagtatccttcttcccacacagctcagaggtgcgtcaccgatctcgatgcactctgggaaatgcctacgcgacacgtgtcctactcctattgctatctttgatgatcactgattctctctgctctccattgtaggttgatcgatcaacgatctcgccaaacgggcgttttcgttgtcgacctctgtctcctttgtacgcatatataccgcgtacgtacggaggcgcgcgcagtgggcgcgctgcgctgccagccccaaaatctgctccattagttgcttgtttgggagcgctcctcgctgagctttgtccccaacgggatcacgagagggggaggaacaagttgcccagattttggacccttgccaatggaagtgtgtgggcttgtcatgtgggaagagccgtcgctttcagggtttaagctgtttctgctcctcctctctcttgctcatgggcaataagtgagattttggttgcgcattagagggatgtgtgccatgtttattgcagctttggctttattttagtccctcgacctctcccaagtgatgataaagactggttgaatagtcagcaggcaggccgtagattggctagcgtatgtaacagtatgatgagatcatgcagtcagtatatcctgttctgagtcgtggaaaagatttgccctttcatggacctaggtcgactctgttcatcacaaatcagagcaggtaaaaatattttgcctaaacagtagtatatttttaatctttgaactgatgatggtataaatgtcttgttgatgttgctgtaggctctggggatatatatatatatatatatatatatatatatatatatatcatatattttagctgtgctgaaactcttggaatttgatcctccgtacttggcatatttcattaaggtaatctctctctcggcctcctactgccgccagaaaattatctgatataatttcgtatgatactatgattaatttcgtactgccggtgttagctcttggctagaggcaaaactacccctgttacatttgcttctgccgctaaatccaaaaaccatgcttgcatatgggcctggggcccttggcgcaggaagtgtctcattgcctgctcatgtcttaatgtttctttgtctccagtgcgtgtgtgactgtgtgagagagaaaaccagagagagagagggatggctaatggcttcttcatgcaaacctatctattagagccactgcactgattcttcacccgattttacacaggcaggcctccctgctgaatggctccagcttttgttcaaccgatctgtcgtttatactacagtgctgggaaacgtgcatgtactgcatgtactaacagatgcatggcatgtgagagttagttaactaggtagtagccctagctagctactccatctattccacgaaaaccaacctaggatatgatgtgattttttttagtacaatgaatctggacatacctctgtttagattcattgtactagaaaacgttacatctcattttaaattggttttttatgggatggagggagtagatgtgatcatgtcacaatatacagttatttacataggttcgcagtcaatgattgctgattagactattagtcgtgcaattaattattagttactcgaatgtgctcgtgcagtagcaggatttggatggtgtagggtaggatttgccagctgatctacaagctacttgcatgtaaactttcatgtagttcatacagggaacgcatttatatatattcccgtaaaaacaactccttcatgtgatgctaattaaatctatgcatcttcgaactaataataataataataataataataataataataataataataataataataataataataataataataatgatgatgatgtgcacgacttgtttgtttgatcatacatttcttgctcaacttgcagtgaggttttgattttgctggtaattagctacgcctagtcacaaaaggcaataatgtggctataggcatatttataagtttcagatttggcacactaaattttttttgacgcaagaaggtagagcatgccctaccttatagtcatttcattaagagaaatgaggtttataggttacaagttatgagtgtagcagagggggtagagggagcagaaaaaagggaaaacaggaaaaacaaaatagacaaaacaaaagagaagaatagaaaacagggggctggatttacaggggtatatacaaagcagtgtcacaaagacagccctgcacaccaggagaattggtacacttaattgatgtgtggatggctttcaaaagtgctttcacaaaataatatgtcaatatttaatatattttatgaatagagcattaaggttgtattgggaccatgctgacatgcatccaaaatgtcactataaccagagagagtatttaatacataatttattgataaattaattttggagccaaacaagggagattaaactccctctgttcttaaaataataaatgttttcaaaagtgtgatcaattttgtaaaagaaggttaatttgttgtatgaacacggaatcacttgttttgcgggacatactttttctttttttggggggtttatattggtgtattagagaacatgtcgatatctcattttttttcttaagaaacacagtataaatgcaagcgcccacaacgcacgtacagtcaccctatgaacgcacatttcttgagattgacgaaggcagagcacctcagaaagactgggccgacatttcttgagattgacgaagtcaccacatatgccttgttgttgatgggtacatcgcctaccactgaaagaataataagccgttgcgaacaccgtgtcaaatctagtttttgaacttgggtgggctggttccaccacaaagaacctaaccagttgagctactctcacttcacgatatctaatattacaagttaatctttgaattggaagcaaatttggtcaaatatatcccaactgatactcttaaattaataatattactcgaaatcaaaagctatagatataattgttgaatttccctggtttagtgaaattctatgccttgttttctctttgatcgtgtttttgaggaaatcatgacgcctattgtacttccaataccacatatatataggagtggattctaaactctcgaggggattatcccttgttatttgcatatcattcaaatgattatgaaaaaaatcaactagatagattaatatgtgatagatcactccacaaacatacaaattaaaattcaacttttacaagttgcaacaaaaaaacaaactaaactatggctagttaacgtgtattcatagtcaaatttattttttacgttacaacttatagaaattaaatttgatcttgcatgattgtggagtgatttaccatataataatctatcttgttaatttttttaatttttttcataaccatttagatggcgtgcaaataacgaggggtgtctccttgagagtttagaatatatgtatgtatgtctgtttgtttcacagtcgaaacccacagatccaaacactttatatatgcagagcgtgccatgcaatatttcattaggaaattaatattacctacattaaggtgctaagctgtttatacatgggaaatatatgtctagtgccattgtgcaaacatatactctatcatgggtgctaattaatttgcttactcgtcacatgagccgttggatgagattttggaacatatatatagtgcatgatgtatgcaacgctgcaatcatcctgcatcacggtcttgagataacaggcaaaatacttttgtagaaaacgatgaatactgctgcgccaggtagggcacacgctgctactgcctgcagctgcatgcatgagatcttaattggttgttgttttggaatgaatgttttgcatgttgtacagtgcgcagtgtgttttttttttccccactgtttgcctttggttttcctgtgctaactgtgttcgccctctttctcaggaaagggatcacacacatggcatccttctaaatcttcctaggcccgagctggagagggattgatggcagctcttggctcctcttgcttcccttttattaaaaggacatgcctctctccactgtccatgatcatcccctgggcccttgtaaattgcccctccaacagcagatcctccggcccctaggcagccacactactctcctctccacatctctatcttccttatatgcaatatccctgatacagttgtttgtactgcctgaagctacaccaatataattcccagatctcctcagctaagctatagcttctctcccatctctttcctcctcctcctctctgatatgtctactatctacatgagccagctacctgctactctccctctaatggagggggatcaggatcaggggctctacccagccttccatagagcaaaggaccctcctatcttgttccctttcatgatcgacagcgccgtcgagcaccaagggcaaatctatggagatcagggcttgaggaggcagcaggttttgggtgaatccaatcaacaggtgaggggatcgatcacatacatgtgtagaacaagctagctacttatacacatgtagatcagtgcttctttcttagtatatatgctgcttgccctaataattttagcttatactcctcttctttttctcttttttttgctcttgcagttcaatgatcacatgatgatgggcggatcagatgtcttcctcacaccgtctccgttccgaccaaccatccaaagcatcggcagcgacatgatccagcgatcatcttatgatccatacgatatcgagagtaacaacaagcagcatgccaatggatcaaccagcaagtggatgtcgacgccgccaatgaagatgaggatcataaggaagggggcggcaaccgatcctgagggcggggcggtgagaaagccaaggagaagagcacaagcgcaccaggatgagagccagcaacaactgcagcaagctttgggtgtcgttagagtgtgctcggactgcaacaccaccaagacccccttgtggagaagtggtccttgtggccccaaggtgagatttacttgctcttacacccctattaacaactgcccaaactcatgtgttgatctgtctgtctgggtgctatatgctaccttactatgtgcattttctctttgttttgttacaccagatcatcatgcatatgttaaagattgttgatttccttggtttaaattgtgtgttgtgctatgcatatggtgcagtccctttgcaacgcgtgtggcatcaggcaaaggaaggcgcggcgggcgatggccgctgctgccaacggcggagcggcggtggcgccggcaaagagcgtggccgcggcgccggtgaacaataagccggcggcgaagaaggagaagagggcggcggacgtcgaccggtcgctgccgttcaagaaacggtgcaagatggtcgatcacgttgctgctgccgtcgctgccaccaagcccacggctgctggagaagtagtggccgccgctccgaaggaccaagatcacgtcatcgtcgtcggtggcgagaacgccgccgccacctccatgccggcacagaacccgatatccaaggcggcggcgaccgccgctgccgccgccgcctctccggcgttcttccacggcctccctcgcgacgagatcaccgacgccgccatgctgctcatgaccctatcctgtggcctcgtccacagctagctagctagctgatcaaaactagctagctactagtaccgttaatttgatgagggcaacaaccagagtactatgtaccactactagcaatattttgtgtgtgccttgtgatcttttgttgttttgtgttgttgaggagatcactagatcaggatgaaggagagatagtgatcacatgtctaaggacgaaataaacgagaacaaactcgctagctagctactagccgggatcaggattatatttactatcagctgagtgattagcttgaggtttttttttattaccccctactgctgctaattaatcaagccacttttgtatcatgtttcttagttctttcttcttgtatctgttatgtttggagctaataataatatggagattggagagaatcggatgtagtgaaactagcagatcgtactgtaggtgtacttctactattcattgggtgtcgttcatggatgcatgacttgttcttgctgttacatatgtcagctagcttatgtatatatatgatctctgtcagttgtcaaaagctggccttctcactttttttgggagacaaacattctctctatcgtgtcagctatatatgcatgcatgtgtgtggcagtgaggctagtccgtagtgaaccctttgattttggaaatgtgtgtcctatatatactatagtacatacaaacttttgctacaattacagtacgtccatacatagatgtctgatggacaatatacaataccagctaccatattagctgtaggtacgtgttatttacatcaatgtattcaaacaatatcgttagataacaataagttaatccagaaagtagcaattgcttgtgtgttccgtttctaattaaccaacatgacgaacagatgtgtaacgttttcagtaaaaaagacatgccttaaaatatctatatattactagtaaacaacaatgaaacaaattaaacatatatccgctcggatgcaaaaaaagaaaaaagaagtgaaaaagatgatgaaacaaattaaacatatatccgctcggatgcaaaaaagaaaaaagaagtgaaaaagattggtagctagggaaaatacaaaaaagtcatgtatcaggccgtatgcagttatggttttttttataagaatgcaagaatgttcaaattgtttggagtttacacaagaaaaacacaagaaattaaaggcacaaagaaatattatatatgcacatgcaagtgagcaatgtaggattttagtgaaatcatgtgtgacggctgctagttcccgtctctttaaatgtatgttaaaaggcagatttgagggtatatgtggtgttgcgtgtgtaattgtgtatgggtgtctacgtctgcgtgtataagaataaaaagatacatacaacacaaaac

SEQ ID NO: 868 - DNA, 3177 bp, Oryza sativa; identical to SEQ ID NO: 812

SEQ ID NO: 869 - DNA, 14955 bp, Oryza sativa
aggaccttgttgcaaaacaagtttcttcaagggtggacaagacattttattttacagtatataagccttgtttagtttttaaaaacaccacctcgaatctttgaacatatacataaagcattaaatataggtaaaagaaaaactaattgcatagtttgtatggaaatcgtgagacgtatcttttgagctaattagtctatgattagacataagtgatacagtaacccacacgtactaatgacggattaatcaagcttaataaattcgtctcgtggtttccaagcgagttatgaaattagttttttcattcgtgtctgaaaccccttctgacatccgcttaaacatccaatgtgacaccagaaattttcttttcgcgaactaaacagggcctacatataagagccagtttaaaagtatagtcaactattagcttcaaatcatctatagtcaatgtaatagccaattcatataattagctacctataaacatatactactacacaattaatatctggtcctacctgtcatacatatattacgtcttgtagtctatgcttaagctggctacaagtctatagccgctgctcttatctctcatcatttatcttctcgatatatatttatagctagcttatagtctgctaccgtacctgctctagatctagttctatttctcaactccaattttctcaatttccgttagcaagtttttcaaactgttaaatgatattttttttaaatattgtatataaaagttatttaaaaaatctcaaataaatttattttttaaatttataattattaatacttaattagtcatgtgctactcgttctgcgtgagtcgaaaatctctctcgaaacagacagatcgaacgcagccgtctcagccccggcgccgtcatcttccgtcttagcctcaccgctccgttccgttccgttccatttccgccttgctcgagccagcaaccaaactgcaaaaccgaccaaccgcacccacccaccccacctctccccacccccaacctcccaaaccctaactctctctctccctcgtcgccggcgaagcttccagaggcgggggcagcgcgagcgcatggagtcccccaccgccggcgggggcgggggagggggcgaggccggcgccgcgtcgtcgtcgtcctcctcctcgggcccctccacatcgtccgccgccgccgccgccaccgcatcggcatccgcgtcctcatcagccgtcgccacccgctacctcgccaagcgcgtgctccgcgggagcgccgtgctccacgtcgcccagggctgcttccgctcccccgactgcgtcgacgtcgttctctgcaaggtcgggaaacacccccccgcttcccgcactcccattcccctgatcggcgaatcgtgtagggcttccgatcgccgtgcgtagaggatggacccccaagggtggctgggttttttttttttttttttaattttatggtcggctcggagcgtcggggatgatgctccttatgccatagatcatgcggttgttattcggtttggaggtccggtctggggtaaccatggttgctctgcttttagtggtgtaaggacatggaggacatgttgccccagtgattggaattgctaaacccaaatattgctgtcatgctaccgattgggttgttgaagctagcgtcggatcagttccattaggagaataataaatgaataattcaaaacatttgctacaccgtcatctatgcctggatgtccctttgttttaccatatttgaataaatttgtgtgccatgctggtagaagaaacagaatgcgggacgatgggaaaagataaatgaaaagctatagacttgtatcactgcgtatattgagtgagctgcttaaattcttacactctgcttgtttgatctatggttgataagccgtgggaaaatgaaataagcaaccaaaaataatttgtgggctaaacttttatatctgtgttcttcgcggtttaaaagtcaatgctggtaattaaactacgatgaaaaaaaccctcaaaatcaactctaaaattcaaatttggctgcggctgataagacaacaagcagacgacgagaggaacatgaatacatatcaattaacatgtgaactcactgtatgatctctgttacaaggctgctgggttagttctgcagaatcctggtacttatttttctttcatccttttattgaaaatattggttattgctgcaggaaaattcactggaattggttgttattggtgaagatggtgttttacaatcaatctgtgaacaaaccacatttggtattataaaagatgttggtgtcttaaactggcgctgtacacactttggtttaatgccgaaggtgcagttctttctcatagcaaagcataatactttgcaatacttttcctgtgcatatggctgtctctacttttcttctgatgacagatgggaagataattatttgccatattcttttcagatagaagggaaagaaattctggttatactttcagattctggaaagctatctcttctttacttttgttctgagatgcataggtcagtgctgctcctttcttatttgtggcatttttttctatcttcacagatcaagctgcttgtataaactcaagacccaaaaatataattaataatgatccaaagtattaagtactgtaatagcctaatgattacatgcaaccagaggaaacagtgagaaatttaaaaaaatggaaaggatgccattttttttatgcctatcacatcacacttgtataggatgtgtatcacttttaacatccaactcgtgtgattgtgtcgaaattgccactagaaagttattaaaatctggaaacacatgcatattagactaccgagaattgaagtgaattgcactgctttttatcactaataactaagctcagttgtacacattttattttttttaatatactgtgtttttcacagtgagaacaaagagcaggataatatttttttgtaaggttcattattcacggaagaatattgtttgcaggtttatcttgtgcgtggcattttcattctgcagttgttatcctgttttgtttgagatttacaagatttgctttgatatattgccccaaaaataactgttgacacagcattttgtatcaatttattgtaggttctttgcaattgcaaatattgaactatcgaaaccaggaaatttgaggcatcggctcgggagaattttagctatagaccgagagtgagtgaaagttcctctctcttgaagtgtttgtttacataaagcttcatttgttacatgatagaatagtctccattatttttatcattagttggtgatacattaattgttgtactacatggcaaccaaaattgatatattaattgctggactgtgttcttgtaaatgggtgcaatttcagtgtcttatagggagaaatatgaaaaatggcatggtatttcagcaaacggcatgaacaatggatgtccaatagtaatgtttcccttgattatgtggcattaagaaagttaaatctttcctgttggtgactgtactctctgctcatgtctgatgtctgatggttgacagttgatgcttatgttcgctttgaacaaaatggagctgtcaccgtttctctattcctgatttcaagtttgcaacacccaggttattagtttatgggaatgtctttcatcaaagtgctattagatctaatccatggacacaactaaactgtagaacttagtgtttgaatactctgggaggcctgtctagtttgaatgattatgaacttgtggtcttgattgacaattatttgttactatctctgtcacaaaataaccacaattctaggagtagtagttacaatttttcttttgttgcgtaatcttttaggtgtatatgataatatgatatcgtaaactgcattatagttgtccaacgcaatactctaatacaaccttttacattataattgcttgatgtgtaaataacctttttgaggacttaaagttaaatggtttatgaagtttcttaactttggttgtctcttgtcagatctaggtttgttgctgtcagtgcatatgaggatgagtttgcatttgtacgtgtttcagtggatcacaaacttcatgctcctaatggaggtaaaatttctgaggtgactcttgaacgtaaacaatgccttttgtgactctcattgcttatgcttagtataatacttacagtacattgttccagactttgaagatttcccatgtcataatttcagaaatatttttatccaccagaaattgaagaggatgctaaaatcatcagtactgcatataataccagcagtatccatggtacagtttggagtatgtgcttcatatcaacatgcctggatgaagaatattatcctgtagttgcaatgatagttaacaggtttgctccaaaatcatattcaatagagctgctacttaagtttgtggcgattacctggcattctaatttatattctgaaatatctttgtttcaacaggggctctgatgtaaatgacttggcactctatgggctagattcccataaacgtactattgaccgcatatctacttatttagaagctggacctttggcacttgaaatctcagaaattccccaactgtatggctttgcacttatgtttcgtgctggtgatgttctgttgatggatctgaggaacccaaaggacatcagttgtatccatagaataagcttgtcaactagtctaattggagatcatgtctccgttgaagattcctgtaggggattagatgtcgatgatgatgtggcggcttgtgctttgctggaactgagagactctggaaataacatgatgagggatgacagttacatggacattgacggtactgataacaaagctgtagtgaaatcaaggattgtttgctcatggaactgggagccaaatgccatgcaaggacatccaaggctgatcttttgcttggatgatggagaatttcatcttctagagtttagtttggatatggaaggagtgaaggtattgcctgagtgtgtccatagaggtttgccttgcaaacctcttttgtggatggacaaaggaatggtagttggatttgtagagatgggagatgggatgatcctccaacttgaaaataatagattggtgcataaaagtgcaattcagaatgtagcgccaatattggatctagcaattgctgaccaccatggtgagaagcaggatcagatgtttgcatgttgtggaatgtgccctgaggggtccttgcgagtaatacgtaatggtgtcaatgtggagaaacttctgaggacagatcctatttatcatggtgttactggtttgtggaccttgagaatgaagagaactgatgcttatcactcttttcttgtattgtcattcgttgaggaaaccagaatactatcagtaggactcagttttaatgacatctgtgatgctgtaggatttcagactgatgtttgcactctggcatgtggtttagtagctgatggtttgcttgtgcaaattcacagcaaatgtgtaaagctttgtttacctacagcatgtgctcaccctgagggaactttgctcccgtctcctgtttgtgctgactggtatcctgatgtcactatcagtgttggtgctgttggacataatgttgttgttgttgctacatcgaatccttgttgcctttacatacttggggtcagatcattatcttcgtttcagtatgagctgtatgagatacaacatgtccagttgcattatgaagtatcttgcatatctattccacaagaggactggagacttgataattcatcttctagttgtgcaacgagtggtgattttcggaaagattttgcagctaatattcgcaagtttgctgtaattggaactcacgaaccttctgtgcatatcatttcgttggaacctggagaagcatttcagcaacttgctgttgggcatatatcagtaaacaacgcgctcggcactcctatcagtggttgtatacctgaaaatgttaggtttgtagcagctgcaaggttctacattcttgcaggactaaggaatggaatgctactgaggtttgagtcacaaacaagcaaagggcattgtttccctggttccttttacaaggagtcctctaccccttgtgatgatacatcccttatgttgattgctgtacggcgtattggaatcactcctgtagttttggtaccgttgcatgacagagccaatgctgacattattgttctcggtgataggccttggctattgcaatctgctagacacagcttggcatattcatccatctcatttctgcctgcttcccatgtgacaccagtgtcttctactgattgccccagtggtctgctgtttgtttcggagaactgtttgcatttggtaagtttctaggactcgtgaaagtgaaatccacaagcaaaacatgcacatattcttttttagggatcaagaataattacattattgcttgcatttcatgctctgaattattaggactcataaaccatgagattgctaaaatctgggatcgaatcccattataatgagttctccaaatagatagtcaggaacatagaaatcatggctgttgattgttatcttataattttctttatgcactcggtgaaaccgtattctctcttctggcatcaaaatttcacacttctcttttttgctgctatttctttagtatccgtttctcttttgccactatcgttggtcaacatccgttgaccatcacatttgccaataaaaaactgttgtacccttgcgaaactaacaaaatataagaaattcaaactatctaggaaaatacaatttacctttttagtttttaaaggttgtacaaataattatggtaggaaaattttcagttagtttaaaaggttcccacgtgtatcttaaaaatggaatttttaaaggaaatatttttgcatatccacatacaaatcaaacagcatagctaccaatattcatgtaaacaaccatgcacataattccttagtatagattattctgtgaaacatttgagaaccaaatcattcccatgctacatttttaaagattaatattagtgataatataattcccaattttatgtttttctaaaaaagtgtattaagtggccataatttagttttcttgataactttatggtataggttaaaatgtcaagtgctgcattattttggaacatgtacaggggtataatggccttttaggggctaacttaacagtcaatggatgttgactagacggtaatgatgaaacaaaaatttgctctgacagaatagtggcaaaagagagaagtgcagattttcgatggcggaagagagaacacagttgcaatgagtgacaaaaagaaaaaaaatcccttgttttattatacatagaactaatttgattcgtgacatcgaaatggtactcacagattttccatccatggtttctctcatatcattgtatttgagattttctttttgctagcatataatttttgaaaactactccctctgtcccataataagttcatttttggtttcttctattttccccaaaacaagttcatttttgaagaatcattgcagagtttgtggaagtaaggaatgattatttgggagaagataaagtgaggaatagttgcattgcgatatgataaagtagggatattctagttgtatatgtgtgggatgggtgaaaaatgaacttatttagggacggaaggagtaactaggtaatgtcatgtaccttgtagttttctctaatggggcattttaccagaggggtggcaatgtagcagagagtgtgtcaccatgtcaagtaaaaaaccctcccattctgtattctattttccccatggccaaagggactttagtccttttcttgttcgtctgaaacatgaaatctcttaatcgtagtcatcctgttttagcctttccctgttaagtttatgtgcttatatttcaagtagatttcttttgttccagtcccttctgttgatctgccataagtatggtgcaattactaggataatttattctaaaataccaagatgataataaaatcatgaccttgtgggtattgttgaaacttgaaagcaatgcttatattattctctcactattggtatgcatgtatgtgttctcacatagtcacatgtttatctcctaaaagtggcttgcatgtgcatttcattgtactgtcagtttaaatcaagtttatcttttcaggttgaaatggttcatggcaaaagactaaatgcacagaagttttcgattggagggactccaaggaaagtgttataccacagtgatagtagaacactgttggtgctgagaactgggttaaccagtgtatcctgttcttcagatattgttcaaatagatccaagtaatggggcattgctttccagattcaagtgcgaacctggtgaaacagcaaaatgcatgcaaattgcaaagatagggaatgatcaagtattaatcgttggaactagtaagtccaatggccgaccaatgatgccaaacggtgaagcagaaaggtaaggacgacaactcatgttttgtttctgctgaaccttgttttgtcaagtttgaagtgtccatggtcccttagaatttttgcactactaatgtttaacttgcaatcctagtgttttttttttgcttggtttgagtataattattaatattaatgatctgttgttttggtctccacttttttgttttctgtctgcccgttgtctggtattctgcaaaagtgacatgggtatgaatttgcaaagcttgcaaccatgaggcacattttttggtttctcactgattgtgacggtgttgccattgcgctattgatcattcaatgcatatttgcagttggatcatcaatatttttttcttgttttttctgcacttaatttagtttttccatttccatatctttgaattgtgtgtatagttaaaagctgcctttatattgttattataactattctctttggatgaaacagtatcaagggtcgtctaattcttttaagcttggagactattgaaagtcctcgtgagagcggttcgtttactgcagcttctaatttgaattcatctcatgctggttctccattcccggaatttgttggatatgcagcagaggagctgtctagtaacagcatgtgcagcagtcctgatgaagtttgctgcaatcaaattcaacctgaactcatggcaggccatttgagatcactagtccaacatacattcaatggcgctgttcttgctgtacatccatatctagatagatatgtgttggcagcagctggaaatgtggtatgattagaagtcaatttttatcatatatgatagtatatctattaaagagtagcttagctcggtaatggatctagataaataaatttgcaaagaagcttgaatgcttgattggcaagttccggactcttgacatcagaatcagttaatcaacatttatcctggcaaataacactatttatgtggatcgtatggtgttggcttctttcacttctatagattgctagaacaacagaacgaaggtgcattagcactttagcatatgagccacattaatagcagaggatttttttttgtaataactactggagagatagactagtgacgattggagttgaggagatggagattggaagggttatttgccattataaaaaaaatcctgaaagaatatcccaacaagagtgttattattttccaaaacaaacagttatcatgacgtcactaaattttctatcattctgttactatctggtgctaatatgttgatgctgacagatccagtttgaataccacaatatttgaaaatcatgatctgagattttctctgccttatcttgacagctttttgtatttggatttttaaatgaaagtccccatcggataaaaaagtatactacgagtaggacacgatttacaataacctgtttgaagacgtatgcatcacggattgcagtgggtgattgccgcgatggtgttctcttctattcttatcatgaggtacaagttgattcaattgaaacaatacatttttatgatgtttatttttatggagcttctttgtcgttacctctaatcctcgtattgatttatgccagaatcttaggaagttggaactgatctattctgatcctgcccaacggctagtgggtgatgttgcccttttgagctgtgaaactgctgttgtatcagatcgacgagggagcatatctgtactgtcttgcccaagattagaaggtatgccttggtatagatgtctatgttatccctttctttttagtttgtacctgttcttttctctggattctttttaatggtagtgcctcctctatactcttctgcatcttggtcatactttgtaattttgtagccttcatgtttagtttctcaatctaattcctttattgacatactaaatatgcagtataaacatcacaatatagctggcataaaatttgccagtgtagtaaggccacatagttgaatattgtgcctagaagctttatgaatttcgtaatagaattcaaaattttgcattacgtttgtgtacttctcatcatatatgcattactttgtaatatctacctaaattaatttaaattttacattacgtcaagatttattttgactttttttaacatatcttgcagtatccgaaagtccagagaagaacctagcggtgcattgttcattttacatgggtgaaacagctatgagcatccagaaggtaagcttctgttggcatcttagggctaaccagtgtgaattccattaacgaaaacataccaaagagagggttttgaacatgggtattgggtagctgctttggatttaaaggatgaatcatgtgtttgtaacttgatgaactaatgggctgtttggtttgaggaatcaaatcatcctaggatgagttttttccagcatgacccatcatgagtaggggtgaaacagtgcggaaacggacggaaacaacctttatcgttttcgttttcatattttttttggaatcggaaaccccgaaaacgaatattttcgaaactgaaaacagagcgaaaacgaaccggtgcggatacggtaatgaaaatttatcggaatacaaaaacccctcaaactgagcttcaaacttttgtcaagtctaattctcaagtctcaacagtcaacaattcgtcataaaacacaattatatcaagtctaattgttaagtctcaacacaagtacacaataacacttaacacggagtgacggaggtggaggttgaggaataacacctgctggctgctgccactgggctgctggctgctgcgaggcgaggcgttgtcggcggtgaggaagagtcgccagtggggcttgaggtgtcgtagacttgtcggtgtggctatggcggcgtcgtcagtggtggtggcggcggcgaaacggcgagacggcggcgcgaaacggcgggacggcgccgcgagatggtggcggtacgagacggcggtatgggacaacgaagagcgactgcgagagaggaagggtgggcacggtcgcgaggacggcaggggcgaggtcacgaggagccgaggacggcagaccagcggtggcgcgggcggtgggcgctggggagcacgatgccgtgatctggattctggatgcgctgctccgccgccggctcgcggtcgcgcgatgccgtgctcccgtgcagcgatcagtgtgtctctcctctctagggttagccgctatttgggtagatgctgcgatttggattgggctgggaacttggggacgacttatagactattgattctatgggcctttttaacttcagaaattccggcaaattttttggaatttttccgaccgattccgagttccgacggaaactgctattatcatattcgatttcgtttccgagaaaatatttccgttttcgattccgtttctgagaaattctgaaaaaattctgaccagctgattccatttccgaaaacaggcccggaatccggaaagtttccgtaccgttttcacccctaatcttgaggtcatcccatgattttgatgggatgatccaatgatcccattcatctttttttttccaactaagcatgtcgctttgaggaatgaggtagaaatttagtagtccattctgctcttgtttggttcggaagttggacctgctggtgcattgagtatccaattacttagatgaaacagcccataattgatctaggagatttgccttgttatctctcatgatcccgttattttccctgaacatttggttttcattcatcatgacccgacccttttctttctatatgagccccatggagaagtgtgaccgaactagtttcatgttttatattgttgctttgctttcctatggttaattcggtcttgtaatttgctgtaggttgcatttaagcattggcttccaattgatgatttgacagaaccagtgttggagtcggtatacaactgtgtcgtcgcaagcactctgctggggagtatctttgttatgattccactcacaaggtgtagttttgaagattccaactctagaatctaaattcatgctattagctatttatctgtgacagctcagtcagggccactgctagcctgtcggtaacatctaaaccaatttgggagattgaatttgctttaagttaatcagggttgtgaactatgatagttttggctaagcttcacaattatatttggtacatgatttttgaaatgttattcacataaataataaaatagaacactttatcgtttagaattatttgttgctatgctgttcctgaggactagatgccatacacattgataatgtaaacaaagtagtcaatgctcgcaccattactaattaaatccaaattgattgtgtttaacctgataatttgtttgcgtactagtgtcgacaactaattggtaaactaagccctttcccattctatatccttttgtaacaaggggccagagttattttatctctgcacactagtgttatgattctgaagctaatgaattggtaatgcagtgaggagcatcaaatgttgcaagatgtccaagaaagactttcggttcacccattgactgctccactcttaggaaatgatcatgcagagtttcgtcgccgtggtatcccggtaagataattaaactgccatactgaaagctagttttttttgcaagtgttgaataaccttatacactactgctatgacagtcgggagtaccgcccattctggatggcgacatgcttgtgcagttcctggagctcaccagcgaacaacagcacgatgttctcaatattgtttctcctggaaagaagaggcaacacgatatctcggttttccaggtcatgcgagcattagagagggtgcattacgcactcaactgaggcgttcaacaatccattcaacccggtcactgttcttaccgacatggctgtctccaacctgctgatatttgggtggcatcatcgctgaatttggatccgagccgagcaccgagttgttgcagctgaagctgctactggagcacatacccagaacataccaaatctcagctgtagtgaggtgctgtgttttgctgtgggatgataggcccatctgatgtcgcaatagtgtgtcattgctctagtgcaatctttgtaaataacgaataatattttggcagaaggatgtggatacaaatccttttgcccagtgaaaggaacaaccctcgtgaacgcataatctccattgtggtatatgtcaacttgcttcaggttatgccagttgaaatagggatctggaaacatttcctgaaatctgacgcttgcttgatctttgtgccttaataaatttgctctctccaaccatagatttattttcttctttacggtttcgaattcatgagataaaggtgagattaccgtgaaagtatatttgcttgttaggggagatttgcgcacatagttttcataacgaagcgttgccagtgttaacagaattactatttgggatgccaagataaacattactatttttttttgttatatttaaagacacatcagacttacactcgtgaatgcactcacatcactcgtgcattactctggtctttgtgcttttgtaagaaaaaacgattagatcgagatggacaaggaaaaaaagagattatatatatttgcatccataaagttacattagggctcatccaactcaatcggatgatcaaactacacaatgaatgaacttaacctacggaaaaagctaatgacagatgaatcagatgaatcaaatcagtctctgattccaaaagattttacatccatccgcgctggtcagaaacaaactggtggcgcttggtttcttgctccgtcgccggcgccgccgcgcgcgccatgaccgccgggatggccatgatgtgcggcagcagcagcgccatctcctgctccgcctcctcctcgtacgccttgaacaagtcgctgtcgtcgtcgtctacttcgctgccgcgtcctccatcctccatgaggccgccgtcgtcgtcgtcatcggcggcgaactccacctcctccggctcctcctcgaactcgacctcgtacggttcctcctcctcgaactccacctcgtacggctccgccgcatcctccgccgccgcggcggcggcatcaagaaacgccaagaactcggcgagcacctcgccctccagccacgccacggggagaagatggccgtcgaactgcacgtactccgggagagacgccgccgccgccgacgacgactccattggccgtgctcctcctccgatcgatcgctgtcgcgcctcgtttgttagctaggatggatcgaatcgcgggaggtagctgctgagctcgagaatggaatggaacg

SEQ ID NO: 870 - DNA, 3828 bp, Oryza sativa
tacacggaatacactaatttttttggaaaatttatacccatataggttctatgaatatcatatcatttataggaattgatttgatttttttccttttttatcaatttaaattttaatttggatgaaacccatcgaaattccaaatggcttctacttttgagccacgtcaaaacctcggttttccgcaaattcgtcggttttcatcggaattgtgaaccctggacggaggtagtagtaggtcacacttatacctaagcttcttttaatctcattttttttaacggttttgctataattttttgacatatttttcagctgattgctataattggagacacatttgataaaaaaaaatagcatcgcataattggcatttgatttccacatggttatgatctttttttttttatcaagaatggttataattttattgctacaaagtataaatataataaaaaattaaaaaatgaattttagataccgttctaagttatagataccgcatcttctattatggtactctaggacgaaggaagtaattaacgtgcatttatggcaatacaatgtatgtgacccaactaagatcatgtttggagaactagtcacgagttattttgagagctattttttagcacaagaaaatagccatccaaaaaaaatagccctaagttgttcggatcaaagggttattttgagagctatttggcttttaatataccttcccatgaaaagagatagagataaaaggcatttttttagtgggccccacccaaaatagtttaaattagcactccttgggtgggatatttttttagatgggttattttcaaatagttctcaaatagctcaccttttagattttttttttggctatttggctatttgagagagggataaaaaataggacctaaatcgataatctgactttttttcccaattaatgtggcacacattgctcattaagtatagagatagatagagagatacagttatacgggtagatcgacgctggtgtagctattgctaacattattgaccagagcattagctagcgagcccaataaatttggtagctaataccgcctattccgccacgtaccgacgcccgttcccgcagatggcaccaccctcgcactgccacaccatcaatggcggtgccccacggaatggtgccatcccggaggtggagacgacgacgtcgacgccggcggcgtcagataccgcgctactgctcgacgctgacgagttccggcggctcggccaccaggtcgtcgacttcatcgccgactactacgccggcctgggcgactaccccgtccacccaagcgtcactcccggcttcctgcgccgccagctccccgccgacgcgccgtcccgcccggagcccgaggcgtttgcggcggcgctgcgggatgtccgcgacctcatcctgcctggcgtgacgcactggcagagccctcgccacttcgcgcacttcccggcgtcgagcagcaccgtcggcgccctcggcgaggcgctcgcggccggcatcaacgtcgtgcctttcacgtgggcggcctcgccggccgccaccgagctcgagatggtggtcgtggactggctcggcagggcgctgcacctgccggagagccttctgttcgccggcggaggcggcggcacgatcctgggcacgtcgtgcgaggccgtcctctgcgcgctcgtcgccgcgagggaccggaagctggcggagatcggcgcgaggaggatcggcgacctcgtcgtctactgctccgatcagacccacttcgcgttccgcaaggccgcgcgcatcgccgggataccgcgggagcactgccgcgagataccgacgtgccgcgacgacgtgttcgcgctctcgccgaccgcgctgcatgccgccatgcaggccgacgtcgacgccgggctggtccccttgttcctgtgcgccacggtgggcaccacccagacgaccgccgtggaccccgtccgcgagctctgcgccgtcgcggcgcgccacggcggcgtgtgggtgcacgtggacgcggcgtacgccgggtcggcgctggtgtgcccggagttccgcgacgtgatcgccggcgccgaggccgtcgactcgctcagcatgaacgcccacaagtggctcctcgccaacaacgactgctgcgcggtgtgggtggcggcgccgtcggcgctggtggcggcgctgggcacggagcaggagtacatcctcagggacgcggcggcggagggccacgacgtcgtcgactacaaggactggggcaccacgctgacgcggcggttccgcgcgctcaaggtgtggctcgtgctccgctgctacggcgtggagggcctccgctcccacgtccgctcccacgtcgccatggccgcggcgttcgaggccatggtgaggggcgacgcgaggttcgaggtggtggcgccgaggcggttcgcgctggtgtgcttccgcctccggtcgccgccggagagactcggcgtcggcgtcggcgtcggaggcgagaaggcggcaaacgagctcaacaggaggctcctggaggaggtgaacgcggcgagctcggggccgtacatgagctccgccatggtgggtggcgtgtacatgctcaggtgcgccatcgggagcacgctcaccgaggagcgccatgtccgcgaagcgtggaaggttgtccaggagcgggccacgtcaatccttcgtaaacgtggctaaaacatctcggtaggtttgatccaaattaagcatggttttctccaagcagattgataaactatgcttttcggattgacacggcaaaataatcctgctgcgtattatattcttcacttaatctcttgactaaattagtagagagattaattgtgttgcattatttaaaaaaagaattatagaataatttataaataagtaaaatataccgattgtatcacaattttacaaggtgacttttttaaatatttaacgccgttgatttttttaatatgtttgatcgtttgtcttattcaaaaaaatttaagtaattattaattattttcatatcatttgattcattactaaatatatttttatgtatatatatagttttacttatttaaaaaaataatcaagacgaacagtaaaacatgtttaaaaaagtcaacggcgttaaatattttgggacggaaggggtatatttttgtcacttgtctagcaaaatactcaaacaagtaaatgatcttttccgaatatgcgaataacgtaaaacatgttccatgtacatgcgtcacgttgatcacttcgctaacacggtcatacacgcataagctacaaataaaccaacggtacgtgcaataattactactagcactattgatagtaaatctgatataagatgaaccttctttttagtgctaaccactatgcagatgtgttgattgaaaaacacaccagcagcaacacactgagaatataggagttgatttgcattttcattgctggtctcgacacataaatttgtcatgcccctgttgctcacgagcgtataatgttagggcaatctaccagcttagcaatgagtacaggccatgcgctatatgttttgtaacattcgtgttgaacaacctgtaagaataaactactaaattacatcctttttaagttgtaataccatcggtatattttatttttttagtaaatgaattaaaatcgcaactgttcccatctttccgtataagctcactaaaaatatactgtaatatttttacggatgaaattggctcaaataagaaaagtatgtgtaatttaactggttggttagatttcttgtggtggaatatgttcac

SEQ ID NO: 871 - DNA, 6414 bp, Oryza sativa; identical to SEQ ID NO: 761

SEQ ID NO: 872 - DNA, 6107 bp, Oryza sativa; identical to SEQ ID NO: 762

SEQ ID NO: 873 - DNA, 3880 bp, Oryza sativa
tcccgatgacctcaatttctattcctccgacattatagatctaagcaagctacctgcagccacagattgcggtgtgtgaactgttgtcaggcatgcagtcattgcctttgccagaatcatctcttgcagtctcgttttctatagaacaaacagctgtgtttccgcgttggtatccaagagaggctggccatgacgaactagcagcaacatctcccagataacttaattggttggttgagctcttcgtcaaaacgacgaagtttaatttgtgcatcaatggaggccagagcgctgcatgatgacatggtgatgccccataattgagaccgcagtgggaacaagtcaagacccatgaggtgatgagaacatccgaggattaaagaaaagcaagactgaaaagatggtgacgcgataactgaactgatcaaccataggataataatattatatagtcgcattatatatacacgatgatcaaatgcacaatctgtctctagctagcccagcagcgttcagatcgagtttgaagcggtacggcttctagtataattctgtgtgggacaccacgatttgatgaacgcagttagaactgtcaatctcatcaggaaattacccaggaatatctctgacttgacaccggcattgaactagccttcagcgttcaagatgcagagatcaggccaataacatcaaaagtcagaataatttatcgattttcaaaagaaaaccaaccacatgttagctaggatgcatcacatttgccactcctaacaaatccaaatcaaacatcttagtttctcctccaagctagcaaaagaaaccaagaacaacaagtccagcccagaattaccaagaaatttatttataactgattctatgattctatcttgactgttgactgaaaattttactagtaccttgaatccagatattccagaaccgtgactcccttctgcagttatcttcttcgaaacggcagtgacaggtatactattcgatcctcgccaaccactcctatgcaaatatgaacacactctctgctccacattaaactagtgctactactcgtctacttgcctacgggaggaagcaataatcaagcagctgatgtttgatagattagacggtgtatagtgctgatcatacaggcaatgcatgagatagttggggaggcgtcgccgtcacacgctcgtaatattctcccgtttgtttaatctccccttcgaaacgcagcgtgcgcggccacaacccacgtccgatcgaaccgagctcccgctactacaacgtcacgacgacacatgacacggcctcctcagctccagtttctttatatcccatggcgtttgcctcgtttgtcgtagctggcgctggtgacggcatccatccaagaactgcctccttgatccatccattcccggcggacagatcacgccgccggccggctcttgtgtatatatatggacggcgagtggagcgacggggcggcggtgtcgtcgccgacgatgtccggcggcggcgggcgggagcagatgaagggcggggaggacgtcgctgcggcggattgcccggggtcgccggtgtcaccgtcaccggcagctgctcagcggtcggcggctggggcggcggcgtcgcctagcgggaggtcgaggcggtcggcgcagaagcgggtggtgaccgtgccgctggccgacgtgaccgggccgcggccgaagggcgtcggggagggcaacacgccgaccgactcgtgggcgtggcggaagtacggccagaagcccatcaaaggctcaccctttccaaggtaaaatacacaccacgacacacgaatcgatgccatggcatcgaatatcgatcgagttcttttgtaagttttgccatgaattggaggggtttttgtgctgatctagctaggcttggggcttcgtgatgagcagggcttactaccggtgcagcagctcgaaggggtgcccggcgaggaagcaggtggagaggagccggaacgacccggacacggtgatcgtcacctactccttcgagcacaaccactccgccacggtgcccagggcgcagaaccggcaggcggcgccgcagaagcccaaggcgcaggcctgcagtccgccggagccggtggtggaagtggaacccgaggaaacgcaccagtacggcgtcaccgccgggcctgccaccggtggcggcggcggcgcggcggccatcgaggtgcgcgacgagttccggtggctctacgacgtcgtgtccgtcccagccacgtcgacctcgccctccgacatcgacgcggccgacgagatgcagctgtacgatcagccgatgttctttggcggcgccgtcgtcggcacggccgcgctcctccccgacgagttcggcgacgtcggcgggttaggcggggaggggctgggcgaggaggaggcgttgttcgaggggctcggcgagctgccggagtgcgccatggtgttccggcggcgcgccggcgacgggctggagatgggaggaggggttaagatcgagcagccggcggagagcacggccatgacatgatgctgacacagacaggtgggcccggtccggcctccaataagaccagacaagctcctgtagtttttggcttcttgttcacttgccaattgtcggttagtttttttccctcctcattttggttattctctacagtagcatacagaaaagaatcggtacaatattattattgcacactgttgattggagaaaggattgagagagacaagtcactttgtcaatggtttggttgaagatttttgttttctcctttggaaccatcaatggatacataaataaagattggaaaaaagaaacacagaaggattggaactccattttttgctctgaaaactctgcctatgtccttgtcatgttgcgcaaatggataacattgaattgttcattactacagaaaaaagttccacttaacgatttcgtgtcagacccaaattctgagcattgtctgcaatagaagggctgtctttgttcacgatctgatcgacggaacatcatgttatatatgaattgcaacgacagatgaatcaaataaaatgtaattttattatgcttctgttgatctgtactcctaatggtcattcatatatatatatatatatatatatatatatatatatatatatatatatgctttgtctcaacttttcttgtggtttggcgtgttgcagcagcgaacacttgacagcaaatcgcgtattcgtatcgtttgactccctcttccaatgtgctcacatgctagtttaatttgcttcatcagaaagaaatcacgaagtacgaaccaagtggctcttgcacgaggcaattaacaatcccaagtaaacgttctacagctaatcaagctctatttgtcagagctggtggtactgatggtatttttcttccaaagggcaggttgatgatgctagtacagtatttcctaggatgctcgattgtgactaaagattcgtagtactcgtgaccggtttcactccgtaggacacggaaattgaggtgataggagtgttgcaaccaacactttgcacagaattagcagcatggatcagggtacacttagcacaaacaaaatgtgaaaacacgtggcttgagttgcaagtagggagtggatttgaaactctatagtccatatttcatgttgtttgcatgccacttaaatatgtaaaaaattaaaaaaaataattgagaagatgtattaatatgtgatatgtcactttataaaaatacaagttaaaatttcacatttacaagttgcaaaaaaaaattaaactacagctagttaacacatatttacaatcaaatttgttttgctggttgtaacatatagaagttaaacttt

SEQ ID NO: 874 - DNA, 3907 bp, Oryza sativa
tatattcttagagctgatcagcttgagcaggagagcaacatgaagggtacagtgcataaatatgaatccacgaaaagtataggaagaaaacttcagtgccatgagggaccccatatggggccatgctatacagctgaaatgtgcatgcctttaaacattcacagtaatcaacctcttagaatatattccaccaaaaactattatctcctcgacggttgccatgattgtacggacatgcatgtatatatagtgaaacagttcaccctgtcttttcttcagatataatattagtactcatcagtcgtcaattaaatttgaccaatcaaccaatcgtactaattaaattatattaattgcttgatcgccatgtttaaagcagcgtgcctgtacgtgcatgatcgacctacatataatatttcctatgttttaatttagtgctttagtttaattacactcttttggggatcttaattaatttcgagaaaaacaaagcacactttggcagaaattaaaaatatatatacctggactggatgaaattaagaggactcgaatgtgaaaataaaacaagtttgcgtggcctgtccttagaacagaatacatgatcagaaaacatgcacaaccacgcgggaaggaacaggaggcccagatggatgcgtacaggaaaaagtacatactagtaagtgtgcatctttcttttgcctgaaagcgacaattaaattgtttcaccaaaaaaaaccaattaaaattatcagtaaaaatactaaaatagctaagaatatatgtatgctcatggaccatttctgtggaaaaagcatgctggcttgcacgaatcaaatttaattaaatatggtacacatcaaaactaaataatagcatcgaccaaaatagtcgattactaacagagattctcgtagccacacatgcctaaacagtaggcacaaacgaacacttgcctgaaaagatcacgcaaaaaatatagcataaaatgacagtctcaacagtgtaaagtttgcaagaatgtgcaattagaagctaacataaacacaaaactagctatcatacatacgagtgaagggctggaagcagctaagctgaaagctcaacacaacatatactaccaatctagctacaaggccactccaagtcgcatatatactagtatctataagctaggctgttctctctttccattcgtcaagaactaccacgacgtcgacatcataatcgtcagagagctcgagaaattttttagtatctttgatccagatcgatcatggagcaagaagctgccatggtcgtcttctcctgcaactccggctccggtgggtcgtcgtcgacgaccgattcaaagcaagaggaggaggaggaggaggagttggccgcaatggaggaagacgagttgatccacgtcgtccaggcggcggagctgcggctgccgtcgtcgacgacggcgacgcggccgtcgtcgcggtacaagggggtggtgccgcagccgaacgggcggtggggggcgcagatctacgagcggcacgcgcgggtgtggctcgggacgttccccgacgaggaggcggcggcgcgcgcctacgacgtggcggcgctccgcttccgggggcgcgacgccgtcaccaaccgcgccccggcggcggagggcgcgtccgccggcgagctcgcgttcctggccgcgcactccaaggcggaggtcgtggacatgctgcggaagcacacctacgacgacgagctccagcagggcctccgccgcggctcgcgcgcgcagccgacgccgcggtgggcgcgcgagccgctgttcgagaaggccgtgacgccgagcgacgtcggcaagctcaaccgcctcgtggtgcccaagcagcaggccgagaggcatttcccgttcccgctccgccgccacagctccgacgccgccggcaagggcgtgctcctcaacttcgaggacggcgacggcaaggtgtggcgattccggtactcgtactggaacagcagccagagttacgtgctcaccaaggggtggagccgattcgtgagggagaagggcctccgaccaggcgacaccgtggccttctcccggtcggcggcggcgtgggggacggagaagcacctcctcatcgactgcaagaagatggagaggaacaacctggcaaccgtcgacgacgatgcccgtgtcgtcgtcaagctgttcggcgttgacatcgccggagacaagacgaggtaacacgcaagcgcagctagctgcatcgtatcgatcatatatatcaccccggcgccttcttcttcttcttcttcttcttcttcttcttcttcttcttcttcttcttcttcttcttcttcttcttcttcacttgttcttcgttttcttcctcttcgatcttctcattcatcttctgttgctgccctagctacaatgatcgatcgatggatgatccatatcatcgttgatccttcgcttcacatcaggttcatcattcctagctacatcgatatatgtacctataatttgatgatgagatgaacttcttcaaaattcaaattaatctctgaagaaaccaacggagaattaggatcagagtgtgctagctacatgtgagctagagattagagaaatttaagagtgtgtgttatatgtaaatatatcgatcattgccagatcgatcgaggcgaaactatagaattttgccttggggtttaattagccttaatttgtacccaaaaattgaaacaaatccgtcccacgcattgcattgggatgtgtaatccgggtttccatatgcatggttatgggaatgtgccatgtgtctgctattgctatatatagttattagtctagctacatttccaaatcacatgttaaatttgttgttctcataatggattcctctgttggagatgactgttcctacaatattatattcgaacttttatgatctcttactgtatgcttgcttcttctgcctacatttaacttactgtacttgtttagctagggttacagtaaaactccctcttcttaatttccttctaattacaaactcgattcttcaaacatatatattcagttcagactcatccaaaccgcctctctctataattcacacattgcatgccagttacttcctctgcttagttaattacaaaggagcacgtatgcacatatcccaagattcagtacgttagttttgactagcaaatagactcacatttagtgatatatgcatgcacaaagtagtggtaccaccactactgtaaatgtacttccaaatatatactcactatatcctataacaacggtatataaaaaatgagtaccactaaggaggaatttggttatcagataatagaaggaattttgagtgtgttgagattcagaccttgtagctgaaaccacataccctttaccacgacagcatctcaattaacggcagtatattgcaagtaggaatttatggttagagttcaatacaactaaaatatatatcgccttaagatcgagaagttatatatgatatggacagtagtgcagtgggtgtgcactttcagaatcgaaatgaagcctatgcgtgtttaaatatataaagagatattacttttcaggtattgagaactgatcagctctattgcttgcatgctagctagttctttatctcccaaatttaattaaccagtttgctcctacaggtaaaataaccatacattatatttctttccgagttagtttgtttttcggcttaattattttgcttagcccatcgaaccaaacacatcctatgggggtgtttagatccagtagtgtaaagttttggactgtcacattgaatattatatagaatgttgcatggggtgtttgggcactaataaaaaaactaattacagaatccgtaaccgtgagacgaat

SEQ ID NO: 875 - DNA, 4284 bp, Oryza sativa
tcctgcagcacagcctgtctctcgcgtcagactggcgctgcgctccccccggtaatgtgcaggcgacaaaggccccatgcgatgcgaccagcagccggcgacaaccggaggtgcccagtcgctggccttcatcgaatcatcgtgcacctcggtcggagtcgatttctgattgttgctgctgctcaaatctggagcttgctattgctgagaactgcttggtggtggtactggaaatttgttgtttgctggctgatgaaaactgttgttctttgctgctaaaaactgctgcttgctagtactgaaaagtactattgcagctgctgaaatatcttgctgcttgctgctgaaaacttcaagttgttaacaccgttcacactaaaaaagctgaaattttttttctgggctgaaaaccccattgttgatgattgcagaaccaatatttttccatgtaaaatacaggagatcgtggtaataatcaagtgaaatatcattttggggcaaatactcagatcgtacctgaagccaatggaaacattgttcaatgcttaaactgtcagttatgatgtcaaagagattgatcactgaatgtcctgaaaggagccgtgaggaggatgcagcattgcagcgtgcgcgagcgtgagtggaggagaggaatgacgattctgttggtagttgtcgatgtggcctactttttttgttttgaggattaaattttgggaatctcttggagataaaaggtattctcataccttaaatcctttttagagatctaaaaaaaatgatttaggggattgaattttgggtggctgttggtgatgctctaagttgcacatcctggggaaaaacctccctaatccatcagcaaaccgatcaaccacccacgacaagtcgacgccaccgttttttttttctccctcctaagtcctaaccccacaaaaatcccgcgaactttcgtctcaccacgcgccgcgtgccccctacaaataccaaacaacacccaccacgtccactcacaaaccacgcaggaaacctcagaaaatcaccgtacgcgacgcgggcccaagaaaaccccgacagaaaccgcgcagcagcaacaccaccaccggcgtcggagatggcgttccggctgagcaacagcctgctcgggatcctgaacgcggtgacgttcctcctgtcggtgcccgtgctgggcggcggcatctggctggcgacgcgcgccgacggcacggagtgcgagcgctacttctcggcgccggtgatcgcgttcggggtgttcctcctcctcgtctccctcgcgggcctcgtcggcgcctgctgccgcgtcaactgcctcctctggttctacctcgtcgccatgttcgtcctcatcgtcgtcctcttctgcttcaccgtcttcgccttcgtcgtcaccaacaagggcgccggcgaggccgtctccggcagagggtacaaggagtacaggctcggcgactactccaactggctgcagaagcggatggagaacagcaagaactggaacaggatcaggagctgcctccaggactccaaggtctgcaagaaactgcaggacaagaactgggatcggacccagttcttcaaagccgacctctccccgctcgaggtaacaacaatttaacagcaagttgttcgcttcagtttctgaatttttacctgaacaattataccgtttcatcatcatcaacaacaaaacggagattaattgcagttgattagtcgtcgcgtacttgttccaattgaaaaacagttgacatttcacgtgttgttcaatcgtttgtgaggataagaaggaaactgctagtgtcactgtcaaagaaacagagttttgcgagagtatatatcttatctaggggacgatgttaacgtgtacggttgcaccagtagtaaaccacgggtagtatttttctaatggaaattaattctgataaggtcatttgggtgcattattagctacgcaaacatcgtttcttttttatctgtcatactgctcacgtactgtttataagagtacctgaaaacaatagcctaaaatatgaatcattctcaagaaatacagattcaattgtcgcatagtcgaataatcagaataattttttgaaaaaaaaacatatttggaatgcttagattaggaatcactaggcattttatactgcttcatgactcgtggtgatattgtcaacgggaggattagactatcttgtggtggagtttcttcaactcaaagcatgccttttctctgaacacttcccaaagttctgaccatcaaggggaaaaatttattggcgccatcttcaaaattcaacggtccggtgccctttcaccaaacttttaggtcgcaaaactcaactgcctcacgaaaatttccatttgataactatcggaacagagtattctatcggaagatgtctgaaattttcagtcctgaaatagtagcacacgttttctaatatccactttaaaccatttgatctgtatgagtaggttaagaaagaattatataactgcaatattatgaaaaccatgttccatgagaaatataactgaaaactttgaagtaatcatacaaagtagaatttgcacataattctggtaaattttggtgtgtgttgatacaattctgaactgatcaaacctcacatctctttccttctcatctgcgtgcagtccggatgctgcaagccacccagcagctgcaacttcctctacgtcagcggcacgaactggacgaaggtgcccaccaactcgtcggacccggactgcaacacgtgggtcgacgacggcacgcagctgtgctacaactgccagtcgtgcaaggccggcgcggtggcgaccctgaagcgggactggaagcgcgtcgccgtcgtctgcatcgtcttcctcgtcttcatcgtcatcgtctactccctcggctgctgcgcgttcaggaacaaccggagggacaaccgcggcgcctatcgcggtgccgcgtggaagggcggatacgcctgatttcattcgatcgatcgatcgatttgcacggcgtaattgattggcatgttcatgcgatcatgtcagatatctgttcataggcttagctctgatattctagccctgtacaggcgagattattctgggttctgatcatctgcttgttactctttgatcaggagtagtaggtttctgtatgcagttctttgatgcaacttagttgcaccctacatcatatttgtactcgatcggatttatttcatatatgtaatatagtattcctttttatttgtttttcagtaccgatctttctaagcttcatcttcgagtacagcaaatattttacctacgagaatagttaaaaaatcatcgaaatgctcttagattattctacgttttggttacaagttatagctagtacagtcatgagttctgcaaacttcttcaaacgatcatcatctatcacgtttactttgtagtagatgaaagaaattagtacaggtttgttcagctaatcggtgactgccaaattttgtctcagattgcacacttatccctggtttacatgtaatatagatgtgaaatttgcaatttgtgctacgcaatgctgcaggcaaattggcaaggttcatcactaaaactagtaggttgataggaaagaatctcacaaaggacaagacgatgagaaggtaatggctagaattatcgtgcaagtgaaagtgaaagtgaggatattttcagggcgtgttaggttcgacttgtctctaacgatgcaccagcaccacagctttcctataatctcgtcatagttgaaaccttcttgcttttcactaaatgcagcattggtaggaagttacaaagtcttactaatgcggtagtgcccattcttatcttgtcctagtaatgccaagacggtgatggattgatggctggtttgtgtcaaatgtgcttgccagattatgctacatgcacaaataaaaggacataagttctatatgtctccttttgaaggataatactttctccgtttcacaatctaagactttctagcattgtctatattcatatatatgttaatgaatctaggcatatatacgtgtctagattcattaacatctatatgaacatgtgcaatgctagaaagtcttacattatgaaacggagggagtaagttgtatatatttatcaaacttactctgaataagttcctgaaccatcggttgatatattgttactgcgtgtaaattgtgctgatgcagtttccagtaagaatgcattcagaactactagttgaaaagc

SEQ ID NO: 876 - DNA, 5803 bp, Oryza sativa
gggggcctgtctgtcattttcaaatgcatttgttgcgaagcaaacaagcaaagagaaagtggaaatttgctcttacccctgcaaaacatgtatcctacctagccgcatcctccgatcgaacaagacaaagcaaatgctccacccacagttccacacgcaacggccagaacaagatcacgtatgccatggcattgccatgcctctgcttagcgcttacgcttcccggctgctggtgatcgatcgagctgggccgttcgctgcatgtgttcacacgggccacctccactgcaaccaatggtaaaatcccacgtcatcgtaaccaaggtgcgacccacacctccacgtcatcatctccagctcgtgtaggtttcgtacgtgcgcgtagaaaaaacgcaccccatattcctaatccagacagcacacaggtctcctcccgaagatggcgtccgttcgatcacgcggtggttcggatcggacggctcggaaacaccggacgcgtagccccttagtcggcgcggacgcgacacggacatcctacggcgcgcataaatcgctacgcgcacacgaccctaccactctatggttttccttttgggtcccacatgtcattggaccacaggcaagaacgctcctctccctccccctctgccgcggcggtcaaaaccagcacgcgccgaaatcccgtacttcccactgacacgtaggccccactgtcattgaccgttacaactcaggaaaaaaaaggggaaccccacccaccagaaacgcagcccccagcaatgataagtgggcccagaggaaatgtggggcccacgggtcagtgggacgtggccgtgccgtgcggggggcgaaaggtacggtcgctgaggagaggctggcgtgggcggtggagcgcttcccacagccctcggcggccgccacgtgtgggccgcagccgcatctcttctctctctactctcccaccctccacctcccgctgcttctcctgttcgtctcctttctcagtaactgcacccacctccacacctacacgcacacagacaaacaaagccaaaccccccgcctcgcctacatctcgcgctctccgccccccgcccgcctccactctgcatggacgcctccgccggctcgtcggcgccgcactcgcacgggaacccggggaagcagggtggcggcggcggcggcggcggcggacgggggaaggccccggcggcggagatcaggggtgaggcggcgagggatgacgtctttttcgctgacgataccttcccgttgctcccggacttcccgtgcctttcttccccgtcaagctcaaccttctcgtcgtcgtcgtcgtcgaactcgtccagcgctttcaccaccgcggcgggagggggttgcggcggtgagccgtccgagccggcctcggcggcggacgggtttggtgagctcgccgacatagaccagctcctcgacctcgcgtcgctgtccgtcccgtgggaggccgagcagccgctgttcccggacgacgttggcatgatgatagaggacgccatgtccgggcaaccgcatcaggcggacgactgtaccggcgacggcgatacgaaggcggtgatggaggcggccgggggaggagacgacgccggcgacgcatgcatggaggggagtgatgcgcccgacgatctgccggcgttcttcatggagtggctcacgagcaaccgtgagtacatctccgccgacgacctccgcagcatccgcctccgccgatccaccatcgaggcggcggccgcgcggctcggcggcgggcgccagggcaccatgcagctgctcaagctcatcctcacctgggtgcagaaccaccacctccagaagaagcgcccccgcacggcgattgacgacggcgccgcgtcgtcggaccctcagctccccagccccggcgcaaaccccggctacgagttcccctccggtggccaggagatgggctccgccgccgccacatcctggatgccctaccaggccttcacgccgccagccgcgtacggcggcgacgccatgtacccaggcgccgccggcccgttccctttccagcagagctgcagcaagagcagcgtggtcgtgagcagccagccgttctccccgccgaccgcggcggcggcgggcgacatgcatgcgtcgggcggagggaacatggcctggccgcagcaattcgcgccgttccccgtctcctccacgagctcctacaccatgccgtcggtcgtgccaccgccgttcaccgccggattccccgggcagtactccggcggccacgccatgtgctctccacgcctcgccggagtcgagccgtcctcgacaaaggaggcccggaagaagcggatggcgaggcagcgccgcctctcctgcctgcagcagcaacgtagccagcagctcaacctgagccagatccacatctccggccatccacaggagccctcccctcgcgccgcgcactcggcgccggtcaccccgtcgtcggccggctgccggagctggggcatctggccgccggcggcccagatcatccagaatcccctatcaaacaagcccaatcctcctcccgccacgtcgaagcagccgaaaccctcgccggagaaaccgaagccgaagccgcaggcggcggcgacggccggagcggagagccttcagcgctcgacggcttcagagaagcggcaggtgtgcatgcatgcagacgattgacatcaatcgctatccaccatagctaggatctcacgcgagtgagaactcgattctcctcctcacacacactccacacactcaaaactcactcactcacatcgctgtccagggatagaatctccaatatttatcaacctagctaattaaacggcatcgattggattgctgcaggcgaagacggacaagaacctgcggttcctgctgcagaaggtgctgaagcagagcgacgtcgggagcctcggccgcatcgtgctccccaaagtgagacagtcaccaccatctcgaacaccttctccttccaaatccactaccccacttggcacaaatccattccatggaaggatcccacttgcacacactcacatacttgatgtttctcccctaatcaaagacggaatttgcctgaaccttctcttcacatttccgatcatggtagaactaaaaagtctcccctttcttgatctgtggatggtttcagaaggaagcagaggttcacctgccggagctgaagacgagggatggtgtctccatccccatggaagacatcgggacgtctcaggtgtggaacatgcggtaccggtgagtaatcaacattcgatcgaagcatcaagcatgatttgggattgcttattaagcttgtttaagtccacttgcttctttgttaattgggaggggatagaaacctctgaaccagaaatagtaaatgactatgggatggtccctttcccaattgggcaagtgggtcatacgaacatatcattggaatctgggagtcaaataggagcatgcattcatcgtgttctatgttgatgctcaagtgcatacaacaaaaaaataaaagtgatcttttcctgctgttttcagtactaacattatgcatatgatttttgctggttctgctgagctcatgtttttgattaattaatttaattatttccattggcaatattatatatgcacaagttattcgaatacatgatggcttagattttgattcactgacattaatggatattgattttcatgaacacaggttttggcccaacaacaaaagcaggatgtatcttctcgaaaacacaggtgaatagcaaacttttgaattattcaaattttacagtcacaagccatgccaataacttccatccttaatttgtggctctcaagtattgttgattaatcgttgtcatatgttttttcaggtgattttgttcgttcaaacgagctgcaggagggtgatttcattgtgatctactccgatatcaagtcaggcaaatatgtaatgttcatccatcattgcccttcccacttctttcgagtactctttaactcaactcagttggatgtgattttgagtgccaataagctatatatagttgctgcatgccactgtttgtctttaattcggatgaccagtttggcagtatctttgtttatggagtacttctgttaatttctgcaagcagcagctaattaattattaaccgtaatcttaatttatctcttaattattagcagctgatacgtggtgtgaaggtgaggcgcgcggcgcaggagcaaggcaactcgtcgggggcggtaggtaagcataagcatggctcgccggagaaacccggcgtctcgtccaatacaaaggccgccggcgccgaggacggcaccggcggcgatgacagtgccgaagccgcagcggcggcggcggcaggcaaggctgacggcggcggctgcaagggcaagtccccgcacggcgtgcggcgttctcgccaggaggccgccgccgccgcctccatgagccagatggcggttagcatctgaagaaacagatgacagcagcagcagcaagcttcagtccatttgaaggttaattattagctagctagctccgtattataaccgatggtaaaacctcctaaaaaaattaattaagttgtgcatgtgaatcgtagcgctagctagggatgatatttgatcagtaacccgtagtccccgtaccagtgacgcttaagtacgcatggtttggttgttcatcgttgaacccctgtagtgtgtcgtcgtcctgtacatgcatcgaattatggaattaattaattaccttaatcgtcgtgtccattgcggctaacaagcagacataggatcatgtttttaatatagttactaccttttttttttttctttctgcgtggttagccgagcatctggttaggatttacatgcatattttgtgtggatctactaatactagcacataaaaaaacccatctcggctagctagagtatatagtattaatttcggcatttcggctgcatatgctatcaaaaacattgaccatccctgcatgcatgtgtctagaatattacaagcctgcacatgcatgcatggccaaatttccatggaccaaggatgcatgatctcatcatgacccgcccaagctgtttgagtttgactaaccccttgcacaggttaattgattcctggtggtgcatctctccacctagcaagattcttgatctggacgaaattaaccaagctaaagtaaaagagtagcctgtttggtggagagctagctgcttctgaattctgatctcttgtcttcgcctcactctgccaggctggagcgacgagagcgcgccatgtgctaagggcttgtggaaacaaggcgatatggcacgctcggttttatgataaactagttggccccgcttcgaggctctctctctctctcacaacgccacgtaaccccgcatcttctcatcttatctcgggtttgattgggagcttctgtcagccgtaatttctcgtagaatctctagctactgaaattttttttaaacagttcagattttaaatttttatccggattctaaaaaactacagcagtagaatctagaaattgacacaaaaactggaagcttggtttgtcagcttctccaaattcttaactatactaacttctcataatattaagggtttgtttggcacagctctagctccatctctcctggagttagagctcagccaaacagtttaagctccacttaaaatgtgatcggagctgggtggagttctctcacaaaataaattagagatgtggagttg

SEQ ID NO: 877 - DNA, 32732 bp, Oryza sativa; identical to SEQ ID NO: 857

SEQ ID NO: 878 - DNA, 17518 bp, Oryza sativa; identical to SEQ ID NO: 791

SEQ ID NO: 879 - DNA, 7506 bp, Oryza sativa; identical to SEQ ID NO: 475

SEQ ID NO: 880 - DNA, 3852 bp, Oryza sativa
catgtcaatgtgttccgacacgtacactagtaaatgaaatggcagggggagggttaggtgaagacaaaaatgtgtttttcataaaagtttcttctacttagtgtgtctagatccagggtgaaaattttttaccgtatcaaatcggatatatgaacacatatttaaagtattaaatgtagtctaataacaaaacaaattacagaattcacccgtaaactgcgagacatatttattaagcctaattaatccgtcatcagcaaatatttaatgtagcactacattgtcagatcatggagcaattaggcttaaaagattcgtctcacaatttacacacaatctgtgtagttagtttttttaatccatatttaatacttcatgcatatgtccaaacattcgatgtgacaggataaaaaaaacttgctaggagatctaaacaggccattatatatttctactatcctataatatcattatatatttctactatcctataatataagacatggtcaaacttgacacggtaaaaaaaaactaatcttttctcttataatttatcatatattataaggtttgtagtgacaaaattatagccatacgaaagtaaattcaaatgtcaattcaatatacaacttttagcaagtaaaattcaattcatatcgtactaaatattggtcattttgaatgtgaaatcttgaaatacgcgagcaccttatattatgtgagtatcttataatgcctatcctacacattttgttaactttattttttaaaagatactagtattatattagactagccagggaatcatcaatcatcattttttttgaacgaaatcaatcatcattttgatacacgggttctttcggaggtgcgcttcatcaagcatccaatccacttgaaccacttgactgctcctaaaagcaatatataagcagaccatcgtctagctaagcttatgatcatgagcaaactcctaataaaatccctcacccataggaaaatcggagcaacgacgtacacgctcaaattcccacatacgcgcgcctcgatcgatcgatcgtctctaagtcgagtcgttggtccttgtgtggttgagagagagagagagatgaatatcgggcctagagaacagagagcatttgcgagaatgacgccagaagaccgagcgtggttgataaagggcaagtcggtggtgctgacgtgcctagcgtcggtcctcctgctgtcggccggcagcatcaaggcccccaagacttgcaccggcggcatgttcttggggcctataatcgctatcggcctcttcctcattgtcatgttcgtggtgggttcgtgtggcctgaagaaaaacgatggtgacctctacgactgctacctcctcggcgtgttcttggcaatcctcctcctcctcgcctttatcatcttcggatacgttgccgtgggaggcatcgacgcggggcatgcggcgaatgcccgagagtacagcctcagtgagtgcaagcgggggtggcttaggggtcgcgtcacccactcctcgcatttctgggcatcaaccagcgcgtgcctccgccgcagccacgtctgcaacggcatgactaacctggtacgcaaccccgacaccggcatttttgttccccgcccatcctccttcgaaaggtgggccaagagacacggggtggacgccgacccacgtgtaatgtcccctatcgaggtacgtaccgcctttttctctactccctccgtctcaaaatataacaatcttgtactagataggacacatattaatacaacgaatctagacaggttatactaagatatgtcccatccagtataaggttgatatattttggaacggagggagtatcattcgcatgcacacctataaaactagcgagaagctccgcgcgactggatacgtgtcgcgcgtggagagaagagcggcgaacactaattgcataaatgagagctaatccgtgagataaattttttaagactaattaattaatcagtaattagcacatgtttctgtagcatcacataagctaatcatggattaattagtctcaatagatttgtctcgcgaattagtctagggttttgtcattagtctacgttctaattaatgtcaaatattcgatgtgacaaggactaaaatattttagccctattcaaactcccccttattaggttgtgtttagctttaccctgcgttcccaactcacatctcttgttattttacctagatgactattctattacattgatgtggaaaattaagttatgtaatatgtataaataagatgtaatataattattaaaacttaaaaaaaatgacttgcatctacagtctggatgctgcaagccaccatcatcgtgtggattaacatacgtgaatgggacgacgtggatatcgacagcagcatcagcaggtgccccagctgccgttgcccaagtaaccaacaacaacaaggacgacgactgtagccggtggagcaacgaccatcaaacgctttgcttccagtgcgactcgtgcaaggctggcttcctccgccacaccagtcaggcctggagtgtcgctgccatctatatcgttctcgccttcatcgggctcattctttcctcacttgcactctacgcagatcaagcaactgggaataataatactggaagatcacgatgagtactagctagcagctactcccagttatatatatacatgtgcgtgaaaatctctgaagcttaattcatttaccttttacctgcagtacgtacgtacgtacaaaagacgtactaggatcgcatgcacgtgcgtggtgtgtaatggtgctatatataaaggcctggtccttaattaatttgttaacgtttttactgaaactagctactctctccgttttatattataagtcgtttgattttcttactagtcattatcaaattagtttcattaaatctaaaattgaatatattttgataatatgtattatttacgttgaaatactactatactcttctagaaacttgatcaaacttaacgagttcatggtgccttgccactatactctcccagcacacttatgctttgtcgtcatcatggttacattgtggtgtcctctgtccttgatatgggatgttaggtcccgatcttccgataggtactgataaacagtcgatttgtgcggagtcgtgacacaactcgatccggcttttgaacgaacacgctactgaggctcacaatcgcagaaccacgtctcctctggttatcaaccgtgccgaaacccggttgacctcgccgagaaggctaatccctgtatgcaaatcgaagaacacaagcaagaacaagatatattgcaaccaaattacatatgaatgattaaacactcgaatttggggttctacaaaccgatctagcggcgaaactattcttgacagaataatataagcaaaacttgactctaaaagataacggctactgaataaatgtgattagggacgtcatagggttgccctagcgcgcacacccccttgggctaagcccacgacacaattacaaggcccaaaacttttccacacacacaaacttccaacttttctgtcacatcgttccaattttaaccaaactttcaattttagcgtgaattaaacacaccctaaggagaaataggactatatttttggcaataactaagggaaagcctggaagctttcatggacactgatgtcacaaactgcacactttgttgctaatcagagatgctgtactgctagcgatcagacttggctgcattttcagtcgcgtgatattttgacagcaaatatttgatcattgcacacatccgcaagccatcaagacga

SEQ ID NO: 881 - DNA, 4699 bp, Oryza sativa
taaatctctatctccatctctatctctactaagatagttttaccggtactttggtataaatcggcttttaagttcgtttttgaaatacatatctgtattagagtcggcttttaaattcgtttgcttttaaaaatacagaattcgtcatataagaaatctcattaaaaaaaagtcacacgctatcttgagacgatcctaactacagctcatgattttctaaaacaatatatatccaagcgaattcccacagtaaattttacctcttaattaaactgtataacaataataagattaaaataaccttcacccgttgcaacgtacggacatcttttctagtatttttaaaaattgaagatgtttttgctggtacttttgtatgtcatttgtgtatgagtcggttttcaagttcgttcgcttttagaaatatagatttgtatttgagtcaggtttttaagtttgttcactttcggaaatacaggagcggtagtataaataatctctactattataaaaatttaagatggttttgctagtactttgatacgtcatccgtgtatgagtcgatttttaagtttgttcgcttttagaattacagatatgtatttaagtcaggttttaaattcgttcgcttttaaaaatacaggagcatatatgctaacttgagatgatcggattcgtaattacagctcatgattttctctctctctctctctctatatatatatatatatatatatatatatatatatatatatatataagtgaattttcatagtgaatttcaccttaattaaaccatataacaacaataaaaattaaaataaccttcacccgttataatacacgggtattttttttagttttatataaaatgtgtcacatgataatagtagtactaacctgattcatttatctattttgaattctttcgccgcgtgcaagcgtacgtgcattccctctccatccactctgctgcagcagccaagaagaaatttctagtcagcagcaaagctctcacctttcccctcctcccaaacacaacaaccacaacaacaacaaaaagctctcacctttcacactcgcatcacacacgctctctcactctcactctcactctcactcagctcgagccacagccgagagagagccatccatggcggtgagcaacaacatcacggcgtgcgtcaacttcctggcgctggtgtgcgccgtcccggtggtggccacgggcgtctggttcgcctccaagcagggcgacgactgcgcccgcgtcgcgcgctggccgctcgctatcctcggcgccgccctcctcctcgtcgccctcgccggcttcgccggcgcctactggaaccgccggggcctcctcgccgcctacctcttcgccatggccgcgctcatcaccctcctcctcgccctcctcgtcttcgccttcgccgtcacccgcccctccggcgcctaccccgccttcgcccgcgcctacgacgactaccgcctcgacggctactccacctggctgcgggaccgcgtcgccggcgaccctcgccggtgggaggggatcagggcttgcctcgccgcctccgacacctgcaggaagctggcgcaggagagcgtcttcttcatcacccccgagcagttctaccaatcacacctcaccccgctccaggtaatcagtaatcctcaattaattcatcgatttaaccatacatcacaccgattactagggtgtagggtgtgtttagttcacgctaaaattggaagtttggttgaaattgaaatgatgtgacggaaaagttggaagtttgtgggtgtaggaaagatttgatgtgatggaaaagttggaaggttgaagaaaaagtttggaactaaactcagccctaatcgcattgcttaattaatcaatcgacttagtttaacatgaccaatgtgactgctagctagtagctagtacaatcgatctctattagtagtacagttgctaggtagcactggttggcaacaagaggaatcaaggaacaatttttgtggggtctaagaataaagtagggttaaattatccccaaatgttgcagcacattgcagttcttttatgagtgtgcaaatcgtctaaagagaaaaggtgagggatccatggatggaaaggtggtgatttgtgtggaaatttcactgtgggggcacttccattattatccatggtaccaatctttgctcaagagaaagaacactgatgaaaccatgaaactgaacaagatttgctggtaattaaggttgtggttatgtgaattgttgatcttaatggtctcgttctagcttaggtgacatgggcatatgggccggcacatgggggcatgtacttaattaactgattttcttaatattagttttctatggttggcatttcgatgttctgtagatgaatcttctcctgtgtagcattagcaatggaggttcagataagtgcaaaccaagcatggctcggtgtgcaagatcattttggaaaagaaatggctcaatgtgctgggccatgtcacctgatccagttcacatttttgtctccttgtgtaactgctatccttggactctctctctctctcaaacagagagagagagaaatccttggactagtatctcggattttgcacatcttcaggtttccgagaaaaaatcattgttcagtagatcagaacacaattaatgcagttcagctagctgacatcaaaatgtcctgacttcgttccatgaatttaggatatcctggtctcattccaaattctggaatgtttacattgttactcctcagtagtacctttttgttcatttacggttcagccaaagataaaagatatgatctcgaatgcttacgtttgaccattgcttaattttgtatcttcaatgctggcaaaataactggaataaatataataatatcgaggtagttttgacgatggatttaccattccattttccaagcagaaacctgaatatttatgcaaatgagtggccatatatctgaggcacaatcaacttgatcgtgtgcattctgcagtcgggctgctgcaagccgccgacggtgtgcgggtacgcgtacgtgagcccgacggtgtgggtgaacccggcgaacccggctgcggacgcggactgcgccgcgtgggggaacgacccgtcgcagctctgctacgagtgcagctcctgcaaggccgggatgctgggcaccctgcgggagcagtggcgcagggccaacgtcgccctcgtcatcgccaccgtcgcgctcatcttcttctacgtcatcggctgcagcgccttcaagaacgcgcagaccgaggacctcttccgccgctacaagtggcgcaactgatcggcgctgctgtctgatgatcaatcagctcctcgccggtgccggtttgcttaacttcttgctcttggctcttgctacatagtatcagtattatatctgctgattaattttacagtgcattgttctgttctgaagattactggatgctgctagtttgttttgttgatctagtgagtacaatctacgggctggtttcaaagcttagccaaatgtatatatgttgccggcttgtgttgttggcacgggttgtcaaatttgtcatggtcgtacctaccgtcagactgagtactcttttgctgtattattgatataatccgtgtttagttctttggccaatttttttttaagtatacgtacacacatttgaagtattaaacatagactaatgacaacaaattacagattccgcttataaactgcgagacgaatatattaagcctaattaatccatcattagcaaatgtttaatgtagcatcacattgtcaaatcatgacgcaattaagctcaaaagattcgtctcgtaatttacatgcaaactatgcaattggttttttttcgtctacatttaatgctccatgcatgtgttcaaaaatttgatgtgacatttttggccaaaaatttttgggatgtgaacacacccacaagctaaaaaactaacacaagtttcagacatcgtacaaaatgaactattgaaggcatctgctacttggtactacaagtaaaaaactaacacaagtttcagccactgtactaaataatctggttcatatgcatcaatcgcctgattagttcgagcgatcgatttggcagtgaattgttaggttagtgtactacacgtgtaatggcctgatgacctgacggttgcagagtctgtgacatacttcttccttttttttgtttgcggacatgtctgatgactttggagatataaaaatcacaatgcataagttgttgcagaagttccagtcttagacaagtttcattgcagcgttcgattttaagcttcttttactaactgatgaaggagacctgttctcaggtttagcacgaagtcatcttgtccggattcagggcacgtagttttggacccagtgtaatacagagtagtttttttgaagttcttctcataaaaattttgtaaaatttaacagtacatgagggaaaaaaaaaggagaggtacagccattgacttgtatagcttaaaactttagaaagtcggcgtgttcatttatttatctggtgatgcttcttcaatggtagcattacctgtgttggagatttgaaattgacctttttgtaagaacaaatgagaggcaggtggtagatggccacctccagttcgtgga

SEQ ID NO: 882 - DNA, 6399 bp, Oryza sativa; identical to SEQ ID NO: 481

SEQ ID NO: 883 - DNA, 4403 bp, Oryza sativa; identical to SEQ ID NO: 491

SEQ ID NO: 884 - DNA, 10170 bp, Oryza sativa; identical to SEQ ID NO: 757

SEQ ID NO: 885 - DNA, 4792 bp, Oryza sativa
cagtgctagtagtctccattctaatctcgcttttgcaaaaatagcagcacagaagcttcttgagaaggatccttacgatgcaacggcttacacagtcctgtcaaggatgttctcctcagcagggatggaggatgaagaaatgctaaaagttgtacagctatccaacttggccagtaagaggcctggttatagccttattatgcaggataaggccactgaaatataacacatactgagaaccttctagttgactagttctagatctctgaccgatgaaaacaagaatgatcatgttacatggcactgctaaatgagaattaggatggcataaaaaagatatcacatgacttgtacataatgcctaaaatgtggatatctgaccaggtgcttggtgatatgctgttggcccagaactcgagatccatttttctggcaggtccttatttcttataggattaagtttgtccattttgatgcagctgagttttcacccttaactatgaaatcatctaacttgcactcttcaactaccaaaatgggcacaaataactccttttcaccacaaaaaaatgtcttatttggccagaataacactggtggttttaagggtaggggttacactgattttgatagttaaagggtgaacaatagatcctttcttttctgagggtaacaattagatagtattgtagttcatgaatttacagtatttgttatttaagacctgtcataatctttatattgattccatcttctttttaaagtttagacagtaaatggaagattgatacacggaattcatctgctacaggaaagcattgaagaatagttgtattgttggttgctgtttgcttaaattcaagaacatttatgcaggagattgtcttccgatcatcaattgatgaagaagccagttcatgagtcatgtctgcatgttatttgtggtagatgaagtaggagatgtattctaaatagctaccatcaagatacagtcatgttgacaggaaaaggcagagcaccaatcgtcaatagtataatcttgctcctgaatgtcatctatgcgttacttacagaaatgtgcaaaaaatgaattgcactgagcacattgctgaataacagtatggaagagaacttttttttgggtgagcacatctgaagagactttcttttatattcattccctcttctttttccttggcattttcagtgctctgcatcacaccatctgtcatgtcaagatcatgacgtttattatatgatgttagttgagatgttgaacaatatagatcagcacaagaatcatgaccagtctaattctgtaaccaattcgcttcaactttagtcacttgatttgctttatcatagagcttgatgagatcccataaataggactataattgccatctgtttctgtaccatggatccttttcttctttccatcatcttatgctcatggatctttgttgtagtgtcctggaaaaagctcaattgcatgaggcgaaggcttccacctggacctccaaggtggccaatctttggtaaccttctccagttgagccctcttccccacaaagacttcgctcgattctgcaccaagtatggccccctggtctatcttcgtcttggaaccatcgatgccatcaccactgatgaccctgaagtcatccgtgagatactcatccggcaagatgaggtatttgcttcacggcctcggaccttggccgctgttcaccttgcctatgggtgcggtgatgtggcccttgctccgctggggccgaactggaagaggatgaggagggtttgcatggagcacttgctgacaaccaagcggcttgaatcttttgctgctcaccgagcactggaggctgagcacctctgtcagtttgtgtgggctaaagcccagtcagggaaacctgtgaatctcagagaggttcttggggccttctcgatgaacaacgtgacaaggatgttgctagggaaacagtactttggtctgcagtcagcaggccctggtgaagcaatggagttcatgcacatcacccatgaactgttctggctgctgggcctgatctatcttggggactacttgccagcctggaggtggcttgatccatatgggtgtgagaagaagatgagggaggttgagaagaaggtggacgacttccaccagaagattattgatgagcacaggaaggctagggaggccaagaagagtgcatcccttgatgatgataacaaagaagacatggactttgttgatgtactgctttctttgcccggcgagaacggaaaagagcacatggacgacgtcgagatcaaagctttgatgcaggtatgtttactgtttttgttattctagtctagttctaagttcatttgttttttaactaagccatcactgtgtttgttgttatagtctattcttgaaattgaaatgatttgctagctgccattatgtttgcaacaaatctagccacgttaatgttatctcctttgagattcaaccaatagatgacttggttcttttaaagaaaataataaaagggaaggtaattaaagatctgttttcacagcagagtttttggttcttctgttgttatgagctatgtttgcttttcggattgaatttatctgttacttctggcaaaccatgttatttcatttctagtgctacatgttggaaccacagtgaagtgatggacagtacaaagtacaaactatcctttcttgtcctggagactacaagaaaattagaagtaaagaaatgatagattttctgaaagtaaactagaagaaaacatgttgaacaacctgtattattcttcaacattatgtgcatgctagcgctactagtatacaactgcatttttcagtatcagaaatcttgcataagacatcaaattagtcataagcaattctgttctaagtagacaaaaacaaaactaatccatgtacacaacacaggacatgattgctgctgccaccgacacatcatcggtgaccaacgagtgggtgatggcggaggtgatcaagaacccccgggtgctccgcaagatccaggaggagctcgacggcgtcgtcggccgcggccgcatggtggcggagtcggacctcggccagctgacctacctccggtgcgtcgtccgcgagtccttccggatgcacccggcggggccattcctgatcccccacgagtccctgaagccgacgacgatcatgggctacgacatcccggcgcggacgaggatcttcatcaacacccacgcgctcggccggaacacccgcatctgggacgacgtcgacgcgttccggccggagaggcacctgccggcatcggcggacggcggccgggtggagatcagccacctgccggacttcaagatcctccccttcagcgccggcaagcgcaagtgccccggcgcgccgctcggcgtcatcctggtgctcatggcgctcgccaggctcttccactgcttcgactggtcgccgccggacggcctccgccccgacgacatcgacacccaggaggtgtacggcatgaccatgcccaaggccaagccgctcgtcgccgtcgccacgccgcgcctgccgccgcagatgtacggtcgccatggcaagcaagtttgagctaggcgtcgtgtggacaataatgcagacaggagaagccgatcgagctatgcagcttaacgtaattaagagtgaattaattctacatgtatctatcaaatcaatcacacatgtagacagtgacgatgaatgcaagtgctgatgaatcaaagaaattaagcatcagctgatgaatctcactttcttgctgaattccattcatttcgttcacacagtaggttctttgagactagatatcttctagtacgtgcaaataatacgcatcgtgtacttcaaggttgtgataaatatatttcgtagcagaagctacttagctcgatagaattgatgatactagctataacttccgagtgagcacaggaaacagagtctgttacgatatgtagtcgtggccttcatgcagagcatcatcttcctcctatcccaacccaacccaatccaatcttcttggtgccattcatttctcagcacatcaacacacatccaaattcatttctgagctcatcagctcgcatcatcactcacaagatgctgcaacggcaatccaactgaattcgatccccaagtaccaggctatataaatcgaagccattctcgccatggatgagcacacaacacacacaagaaagaagaagaagaagaagacgacggcgaagatgaagggagcggctgcggtggcgatggtggtggtggccggctgcttgctggcggcggcggcggtgtccgtcgtcgacggcgcggtgacgtgcggcgacgtggacgcgagcctgctgccgtgcgtggcgtacctgaccggcaaggcggcggcgccctcgggggattgctgcgccggcgtgaggcacctccggacgctgcccgtcggcaccgccgagcggcggttcgcctgcgactgcgtgaagaaggcggcggcgcggttcaaggggctcaacggcgacgccatccgcgacctcccggccaagtgcgccgcgccgctgccgttcccgctcagcctcgacttcgactgcaacacgtaagcattttcaaacaacaaaagaaatagaaataggacttaaaaaaggcacgaatattaaggaatgatctactattaaataattagaatgggtaaggcttcgaagccaaatcatctagcgttggagctagccggaagatttctgagcgtttccca

SEQ ID NO: 886 - DNA, 3596 bp, Oryza sativa; identical to SEQ ID NO: 362

SEQ ID NO: 887 - DNA, 7562 bp, Oryza sativa; identical to SEQ ID NO: 509

SEQ ID NO: 888 - DNA, 3813 bp, Oryza sativa
cgttttacccctactgctataacgacatacattttgtaggataggagtaagtacaataaatgcaagttggcaagtgcagcagtcgagcaacttgcctgccggcgctcgacctacaattggcaagtggtgatcagccagttgggcctttttttcgtggcacccaatttggacaacgacgcagaggcaagggtccgcagcaaggacggcgacgaccatgcagaaaattaaacgcggtgcggaccgtgcggtagattcttcgcgtttgctgcatgcgcgcgagggaggaagaaacaaaccacacggtgagaacggctatgtagtaatctctgggactctgccgactgccggacgatggcatcttcgcgtaacgtacgtaacgaagaaggaggccggtctggtccaagagcctcatcgcacgggagtagtactgtagtatccaatcagcctgatgtgcgatgtgcgacgccctggtcgtcgatccacagttccacacatgaatttgctgcaagtttaactaatgcaccaaaagtgcatatactattagtgaactaaaacatcacatgacaacagtgcattagtcgtagtacaatttaaacagtaagattccctggaaccaaccaacaacttctctgcctcgagaatcgagatacagagcacatgccaaaatggtatacaaaacgatatcatcgcagagccgcaacagggcggtacgtaccgttttggagaggccgcgatacaagcgatcggcccgccgacgccgtcgttagtcgtcactgatgacgagcgcgccacgctcctgcagtctctgacaatgattgagccagcggctggaagcgccgttgttgctgacgagcattctaggaagggcggatgagcgcgagggggcgggaacagatgtgcgtccgtgtcagccctcgaatctctgatgctctggatctgcgcgatatcagcaatgggaattggaagctactgatgtaactttttccccacatatttgtcttcgactgttcgtgcgtgtgtgcctataactctatatataacctgtaaaagtgtataggctacggggcattaaaaatcctagaaatagacaagcataaacaagcaaccagtgacaagagcactcgatggcgattggcacggtggaatcggtggccgtcgtcgcggtgcccttcccggcgcagggccacctgaaccagctcatgcacctgtctctgctgctcgcgtcgcgggggctggacgtgcactacgcggcgccgccggcgcacctccggcaggcgcggttgcgcctgcacggctgggaccccgacgcgctccgctccatccgcttccacgacctcgacgtccccgcctacgagtccccgccccccgacccgaccgccccgcccttcccgtcccacctgatgcccatgctggagagcttcgccgtcgcggcgcgcgtccctctcgccgcgctgctcgagaggctgtcggccagctaccgacgcgtggtcgtcgtgtacgaccggttgaactccttcgccgccgcccaggcggcgcgtctgccgaacggcgaggcgttcgggctgcagtgcgtggccatgtcgtacaacatcgggtggttggaccccgagcaccggctcgtgcgcgagcacggcctccagttccaccccgtggaggcctgcatgacaaaggaattcgtggagctcatcagccgggcagagcaggacgaagagaacgcggccagctccggcatactcatgaacacgtcccgggcgctcgaggccgagttcatcgacgagatcgcgacgcacccgatgttcaaagagctgaagcttttcgcggccggtccactgaacccactgctcgacgcgaccgcccggacgccaggccagacgcggcacgagtgcatggactggctcgacaagcagccgctggcgtccgtcctctacgtgtcattcggcacaacgtcgtccctccgtggcgatcaagtcgcggagctcgccgcggcgctgaagggcagcaagcagaggttcatctgggtgcttcgcgatgccgaccgcgccaacatattcgccgactccggcgagagccggcacgcggagctgctgtcccggttcaccgcagaaaccgagggagtggggttggtgatcaccgggtgggcgccgcagctggagatcctcgcgcacggcgccacggcggcgttcatgagccactgcggctggaactcgaccatggagagcctgagttacgggaagccgattcttgcgtggcccatgcactccgaccagccatgggacgcagagctggtgtgcaaatacctcaaggctggcctcctcgtgaggccatgggagaagcacagcgaggtggtcccggcggaggccatccaggaggtcattgaggaggcgatgctgcctgagaaagggatgacaatacggcggcgggcaaaggagctcggcgaggccgtccgcgcgtctgtggcagacggcgggtcctcgcggaaaggcttggatgacttcgttggctacatcacaagatgaagcaggaatgtctctaattcttcgagcggtcggatatactatactccgtcctattaaaaacaaatctagaacatgatgtaacatattatagcactataaatctagacatgtatatccggattcgtagtactaggatgtatcacatctggacggagggagtagatttgaatcattcgtcaaaatatattaaatttgaaaaatgctcacagtaggaaaatatatgtactactctctctgttatcaaatataagtatttgtagaattcaaattatgtcagcaatataagcatttctgaaatactgatctcaatttacggggattcaaattattttcagactatgaggatcctaccagggggatactaacaattccaaatttaaaatttgatcaatcactgaaaactaatattttctcttatcttcaaatttcgctaaacaacctaaagtgattatatttatgaacggtggtatgatatatattttttcaagggaactgcctgactacctgtgtctcgctccagccccatcagatggcgaccaagcgcccgcgtcgcccgccacctccctcctcttctccgcatcgccgctgcttgagcaggccaccgacaagccagctgaccgcaaggatcacaacggcggagctcccttccttcccccgaggacactacagcgggcaggtgcaccgaggcagcggagaaggtgccgtccagatccggggtgacagaccagcggcaaggtcggcgggcagcggggaagagggtggtgagtcagagtctttgtttttttctgaacaatcttactcagatatagaaacacgttattatttatttacgaacatatacccccggcactcgaaaaaattggaaataacaattaggaaatgtgaaggtccaaatggcggatcttaatagagtttagtggagctcaaaaattcaccgttagcctccacatcttcaaaatcaaaatatattaattagaaagaaatactcacgaatgtgtatagaataatagaaagatgtactagaagataggcgcgcttgttggcgtgatcgctaattaagcatgtgtcttatcttatttgttggagattatatatatgctatttaaatcttttttggaatttacatttttatagcagttagttacatactcataaaatttcttataaacaccatacttttaaaggtatgttttagtgtgttcttagtttcatgtttgtagaattatgaagagaaaaaaatgaaagtatgatagtaatatatgcttaaaaagcattcaaggtggtagttagtttaatg

SEQ ID NO: 889 - DNA, 3686 bp, Oryza sativa
cacggtgagaactgagaacggctactgttgtactccctcagtagcataaaaaaccaaactataatgttagatatgacacattctaacactacgaatatatacatacatatattcatatttgtgatacaagaatatgtcacatctggtataagaatatgctacttaaaaattaagtttgaaaatttaaattttgacttttgcttattgatttttagttctaccgatggggctcttatactccaactcttgccctgtttagattctaatattttttattgggtgaataggcaaagtggtcctccaaatttcatctgaggctcagtttagtccttgatatttcaatctatccatattagtccttcaagttttcattttagttcaaacttatccttaaccaacaactctcttcataaatgatacttatacccctcatcattcacatatataagagagaaattgcatgcttgaattttttttatagataatacatagtatattatgtaaaacgaaaaaaaaatatgtattagcaagtgtatacgatagcaattgcttaagtttcatgtgcacatgttgaaataatgggaagtagatctgtaatgttgtttatttatgttggctttctcttttctagtatatagatgtatataaattgggggcaaaaaggacattttctaatagaaatattgactagaaatagccatatggcatattaagtggatccaaggatgatttcaagccaaaacaaatatttgaagtatctatgtggacaaaataataggtgaaggatcaaattgagccttcgctgaaacttgaggggctaaattaactattcacctatttttcttcaaatttctaactttttcgtcacatcgaactttcctacacacacaaacttttaacttttccgtcacatcgttttaatttctttaaacttttaattttagcgtggaactaaacacagcctcattattgtgtgcctatataaagcctgcaagtctagaggctactgggcactagaattctggaaggtagacaagcataaacaaccatatatcagtgacgacataagcgctcaatggcgattggctcggtggaatccgtggccgttgtcgcggtgcccttcccggcgcagggccacctgaaccagctcatgcacctgtccctgctgctcgcgtcgcgtgggctggacgtgcactacgcggcgccgccggcgcacctccggcaggcgcggtcgcgcctgcacggctgggaccccgacgcgctccgctccatccgcttccacgacctcgacgtccccgcctacgagtccccgccgcccgacccgaccgccccgccgttcccgtcccacatgatgcccatgatccagagcttcgccgtcgcggcgcgcgccccgttcgccgcgctgctcgagaggatctcggccagctatagccgcgtggttgtcgtgtacgaccggttgaactccttcgccgccgcccaggcggcgcgtctgccgaacggcgaggcgttcgggctgcagtgcgtggccatgtcgtacaacatcgggtggttggaccccgagaaccggctcgtacgcgagcacggcctcaagttccaccccgtggaggcctgcatgccaaaggaattcgtggagttcatcagccgggaagagcaggacgaagagaacgcgaccagctccggcatgctcatgaacacgtcccgggcgatcgaggccgagttcatcgacgagatcgccgcgcacccgatgttcaaagagatgaagcttttcgcggtcggtccactgaacccactgctcgacgcgaccgcccggacgccaggccagacgcggcacgagtgcatggactggctcgacaagcagccggcggcgtccgtcctctacgtgtcattcggcacaacgtcgtccctccgtggcgatcaagtcgcggagctcgccgcggcgctgaagggcagcaagcagaggttcatctgggtgcttcgcgacgccgaccgcgccgacatattcgccgactccggcgagagccggcacgcggagctgctgtcccggttcaccgcagaaaccgagggagtggggctggtgatcaccgggtgggcgccgcagctggagatcctcgcgcacggcgccactgcggcgttcatgagccactgtggctggaactcgacgatggagagcctgagccatgggaagccgattcttgcgtggcccatgcactccgaccagccatgggacgcagagctggtgtgcaaatacctcaaggctggtctgctcgtgagaccattggagaagcacagcgaggtggtcccggcggaggccatccaagaggtcatcgaagaggcgatgctgcctgagaaagggatggcaatacggcggcgggcaatggagctcggcgaagtcgtccgcgcgtccgtggcagacggcgggtcctcgcggaaagacctggatgacttcgttggctacatcacaagatgaagcaggaatatcctgtgattcttcgagtggtcggatatgctataaatattaatcttacgtcgaaacatatcaaattttaaaaaatggcctaagtaggaaaatatgtgtaccactccctccattctcaaataagcatttcccggattcaaattctgtatgcagtagccatttctgaaatactgattccattgtatggaaattcaaatcatcttcagacaatcaagtgctatgaggggattttaacaatttaaaatttgatataaggtgattgaaacgaaatatttggtcttatctttttctttttctaaacaaaaacctacaggtgcttagatgtatgccggacgggccaacaggcccagcatattctaatgggctcacattgctctaccatggtgaaaagaaaaagttcactcgaggtctctcgctttgtcgttgagtttcaaaatcgtccatgaatcatgcaaacgaggcccccaactttcaaaatcattcaaacaaggtccctcgatgcatggtaagtccgcagtggctgatgtggcattaggagcaaaactagaaactaaaaaattaaaacaaaatatgcgggcccacatgtcatcctcacctgccaccctgtccagcgtctaccatgccaagattttcgtcaatctctacatctaccccgttccctcctcccttcgcatggagctcaaggcggtggcagagctcggacgggctcaccggacacctccccctctctcccagaaccgttgaaccacctctcccccctttgccaccgacggcctcccaggctcgctgaagaagataagagagagtagaaaagaaaagagaaaagagaaaaaataagagatgtggaccctacattttcttcttctctcttacatatgggtcctataatttttttttttgttactaggatgccacgtaagtgaaactagagatcagtactgctataagatataaattgcacggttttatatagtttaggagtgaaaatttctagtattaaggattagggatgttatacaaactcgacataaagcttaagggacggctggtgaacttattcctttcctcccctccacacgtggcccgtgtacaggccgacagacaagttttccgggggggggctaatgcgcgactggtcgcgcagggtgtgggcacatgaacagttcgctcctactactactactagtctactagtactactactagagta

SEQ ID NO: 890 - DNA, 3767 bp, Oryza sativa
cccaactccattgcttctccaccactgcgccgtcctctccggatctcggtcaccgcatctcccgcggtggtgggtcgatgttgctccagggggacccgccaccaccgccgctcaagccaatctgctcatgccggcctcgtccccttcgtcgcgccgcactctgcctgggatgttgggtgccttttcgttgtccctcgtcattgctagacccaaccgccgccaccatcgaccagggggaccacccccaccgcctgactgctccgcccgtggcccacggccgctttgcttcgccacgatacccgcccgcccctctgctccgccccagagctctgccagcgaccgcgtttccggtatcgcgagcttactcctcgtcgtcgacgccgtctcctcgctcgcagcggcgtccacgatgttgtctctacagtgatgacaacgaggaaagggggagagaaaaagaatggagaaaagatgggtggccatgggtcccactgtatttttaactaaacactcgatgacatgtgggtcccaccttttgatttaattttaattttgatattttgctatcaccgtcacataggacgaagaccaagtcaaatcagccacgtagatgccacatcagccgaaaccgccatccgaactggcttaggaccttatttgcactagttttgagttttgatagttgagggactgttgtatccggtattgcagtttaggatgaaaatcagattccatgtcaagctaagggacctaaattgaacttagtcctttgctaaatgaaaaactttgggccaaactaactatagcccactcattgctttagctgaacggaaggcccatgcacaaatattaaagtagatccaatacgctatgagatgcctagcactatgcatgccgatcggacggtgtaaaaaatttgactgaaatcagccacaaattcagtcgatagatttttcgtggacacgtactagtgggcagctagtgtagctagtgggcactgggcagcggccaattacgtttcgttagtcgttaaaacagttaacacctttcaggcttcattcagacttcagctcagtcattcaggcattgagaggcacggagaatggcagagaaggggaacccggcgaacaaggtggccatcgtggcggtgccgttcccggcgcagggtcacctcaaccaggtgctgcacctgtcgctccagctcgcgtcgtcgtcgcacgggctcgcggtccactacgctgcgccggcgccgcagctccgccaggcgcgggcgcgcgtgcacggctgggacgacaaggccctcctctccgtccagttccacgacctcggcatctccacgtacgtctctccgcctcccgaccccaccgccgacacgcccttcccctcccacctcatgcccctctgggaggcgtacaccgcggacgcgcgcgccccgctctcggcgctccttgacgagctatccgcttcccaccgtcgggtcgtcgtcgtgtgcgacaccatcaattccttcgctgtcgaggaggcggcgcggctgcccaacggtgaggcgttcccggtgagctgcgtagccgtgtcggccctcgcccttcacatagacaccgggcatcggctcctgcgtgagaacggcctcaatcatgcccccttggaaacctacatgacgcaggagttcctggactacgcgagcgaacgtgcccgagcgtcggaatcgattttgtccggcgccggcatcctcgcgaacgcgagccgagcactcgagggcgatttcatcgacgatttggctgagactctggctgccggcggcaagaagctcttcgcaatcggtccgttgaacccactgctcaacacgggctcgtcggagcagggcaggcggcgacacgagtgccttgactggctcgacaggcagcccccggattctgtgctctacgtgtcgttcggcacgacgtgctctcttcgagttgagcaggtcgcggagctcgcagcgacactgcgcggcagcaagcagcggttcatctgggtcatgcgcgacgccgaccgcggcaacatattcacggacaccggcgagggcgagacccggcacgccaagcttctgtccgagttctccaagcaaaccgaaggcacggggatggtgatcactgggtgggcgccgcagctggagatcctggcgcacggcgccacggcggcgttcatgagccactgcggctggaactcgaccatggagagcatgagccacgggaagccgattctggcgtggcccatgcactccgaccagccgtgggacgcggagctggtgtgcaaatacttcaaggcaggtctcctagtgaggccatgggagaagcacggcgaggttttgccggcggccactatacaggaggtgatcaagaagatgatggcctccgatgaaggattggcggtgcggcagcgcgcgaaggcgctcggtgatgccgtccgttcatcgcgcaatgatctggaggacttcattgctcacatcacaaggtgatcgaagaataaccccgtgtcaaaaaaaaatacagctttaaactttttcagtagtagcagtttgtattgaatttgactatttgagttaagcagggtctagtaaaatagttgactatttgagttaagcagggtctagtaaaatagttttcagtcctacaaatcaagtgactctatggttgaatcaaataaacatatggtggtgtaaacttggggatatcagatatccaactatttccattgagtaattttatcatccttaaaaagtactgtaaaattcctcattttcatttctcatagcatttacgttgtgttatatatatgccggatttatctaacagaatattcaaaataacaaaacaacttaccactaaaagtacgtgttcgatagatatcactgatttctcatggttgtgcgctgtagtgctgctctccgctctatcctgaagttctggttagtgttctgctctgaactttctgattaactttgcaactcaggttgttcaaacatgacaaagacaagaaggaatatgaagaaactgtcaatgtgtggtccttttcgttgattcctagagcacatagacccaaacacgtccagctccactcacccaagagctgacaagatggaaaagagaaccggtaaaacatccatctatgcatgatccataggaaaggccaaaaattctagataatgcatatttcattaagcaatgaaattacaaggaaaaagctcatttgagatttctcatcttatcgtcaagttttaaaaccatccctaaaccggaataccatatataacatatctctaatcttacaaaaccggattacattctgtcccaaggcagtattgagggtggttttggccaatgtggcgctagtgtggcaaaaaaaaacacgtgggacccacatgtcaatgaaaacaatatattcttccttatctccctccccatccttcggtcctggcggcagctggaggcggacgtggtgacaatgaggcgcacgggcaatcggaggacgaggagatggtggttggtctacggcgtgcccgacgacagcggcggaggaggtcagcgagcaacttgctaggagggggaaggaagagaagtttggtgtggcggcagcggggaagtagagaccatgggcccgtcgggccacggcccgggcttcctccaccgccgtttcgtcggccgttgcaccgccgctgctccatgtccaacaagagcgaacccccggcaacgataggccacagctcacccacatcctccttgttctggacc

SEQ ID NO: 891 - DNA, 6183 bp, Oryza sativa
attcggtgagggagaatgacaactagttgtattgtgaatgacctaagtgctagaccttgtaataaggctgcgttcggcaaagtgagttgctagctccacctcatttgttttctgcgtacacgtttcctgaattgctaaacattgtgttttttatgaaaaaatttctatacgaaagttgcttttaaaaatcatagtgattcatttttaaactactacttaattaactatatgctaatgagtcgctccattttacgtacgcaagggattaacttgcatctcaaagctgtaaaacacaacctaaggacttcttaggctgtcttctttcctaggtgatctgggtgattgtgagtgagttttgtttcgttttccgcgcgcacgttttccgaactactaaacggtgcgttttttgcaaaaaaaaaattctataggaaagttgctttaaaaaatcatattaattcatttttgaagtttaaaatacttaatagtcaattaatcatatgctaatgactcacctcgttttgtgtatcttcccaatctcctctatctcctctcctcaaacacagccttagtagctcaataaaaatttacaagttgcaggatatttttttacttgttttgctgatataatctcgtcaacggataacatcaaccaaacaaacggacaaatatttcaaaaacggtcttaccatcaaacacttctgttgcgtacacaccactgacagagtagcaacgcaccaaacacttccatcgtcattagctgctaaagtcctaaactaaaccatcaaaacaactgcttccgatcttttcaaagtccaaatcacaaatccgcaagcaaatcccacctctcacgcccataaaaattcgccccaaaaaagctaaaacttcgtccaaaattcaggaaaattacttgaaagcgtgacgcggacacgtggcgcctccgtagtggtcgagaaacctgagcaaggcctactggataagaaagatgggaagatcccatccctccaaccccaagcttgtatagccttttctcctctctctcgcgcacgcgcctttttgcgcctaatttaccgttttacccctcgccggcggccgccgcactccggcgagagaatcggcagcaggtgggcgggggactccacgatggcggccatatcttcgcttcccttcgcggcactgcgccgggccgccgactgcaggccgtcgacggcggcggcggcggcgggggcgggggcgggggccgtcgtgctcagcgtgaggccccggcgggggtcgcgctcggtggtgcgctgcgtcgccacggcgggcggtgagcttgctcgctcgcgctctctctgttttttttctctcactcactggtgcttctggcgtcggtgatgaacacgtagtggtagtgcgttcgattgcgacagaagagcttctctttttgcgtgggggtttcactagcaaaatctggatcctggttcttcttggggatgctgcaagattgtttgtggcggggactacaagccaatctagcgtcctatgtttggaggaagaactggcaactgtgatttttgggtgaacaattagcatttgtagttgtgtatccatgcggttttgatgcttggttattctttctagcagggaattcatgtctgttttagatgcgagcttgggaatttttttagaatttcgtatcactagtttagccatatgtgattttcaacaatctagctgattttgatccacaaatagcgaagggtaggactattcagttgtgtatttgttttttgccgggtcggcgaaggagccgaccaaatttcattaagaatgaaaggagagtttacaagtttacacgacattaaactgtcgagccggggagaccccggagcagagaaacaggatcagttgtgtatttgcgccaatcatcttatgttagccaaacctcacaagccctggttagctgttcaggcctatgattcctgcttttctgttgaattgtggcagtaaactgccaaatgcttccttgtagaacgatttgatgcgtttacatatttccgctcatttcgttccacagtttcttcatggtgttctgttgcttctgccccctttcctgtcaactttcttcaattcatcgagcaagtgccgattacttgtcaagtatttgatactggatcattgtatgtccaaatgttttcagttattatgatcacaaaggcagcaactaacttataacatattgtacacagcatgatgaacaagttatcgccacagcgtttttcacttgttctgaatattgtgcagatgttccacccactgtcgcagaaacaaagatgaattttctcaagtcatacaagcgtcctatcctaagcatttacagtacagttctacaagaacttttggtacagcaacatctgatgagatacaaaacaacatatcaatatgatgcggtgtttgctcttggttttgtgaccgtctatgaccaactcatggaagggtaccctagcaatgaggatagggatgcaatcttcaaagcatatataacagcgttaaacgaagaccctgagcaatacaggtgcctactgtaacttacaactgttttttattcacagtgatgttagcatcttcttgttttatattcaattagatttctcataaccaaattgaaccttcaaacaatatcctacacttaattgatccaagtaatttttttatagatttatataattcacagccatgaattttcagcataaatattacccccaattcgttgaattcatatgtcaaccatagccttttcctatagagatagtagcaattatctatcttgccgctgtaaaaaatgtcacattttgcactatctatttgttgcatgctttgcttatttgtggatcaccaattatctgctttatttgcgtcaatgaaagctaatgtattattgggttactagtttgttttggcatcaacagaggtgtctttccaagcaatcatagtaagtgttttctgttctttcttcagagctgacgcacaaaagatggaagagtgggctcgttcccagaatggtaattctttagttgagttttcatccaaagatggagaaatagaggccattctgaaagatatttcagaaagggcccagggtaagggaagcttcagctacagccggttctttgcagttggcttgttccgtttgcttgagcttgcaaatgcaacagagccaaccatactagacaaggttgttattgccattaataattttgtttctgactatcatacttatttttgcttcacttccaaattatatcttctaataacgcttatgtgtgtttctcaagttatattttagagagcatgtttccaatacattttagttttcgcagaaagaaaggatttatctcaaatcaattaaggggttggcttgtgtctgctgtctaatatcttgcaaccacagctggttaagtgtctatgcggtgttctttttaacctactacttcgctgatatgctagattactagtaaaggactaagtctgactctattccatcctacagcgtacgggcctgtttggcacagttctaactccagttccgcctctcctggagttggagcccagccaaatagttcaactccacctaaaatgggagtggagctgggtggagcgctctcacaaaatgaactagagaggtggagcttgggtttaggcagctccacaactccactccgaacccaactcctagagttaaattttaggagttggagctctaccaaacatgccctccatacctattgactaagcctctgactcgactccatcatactttcctattgactaagcctcttactcgactccatcattcattcctatcacttcagaaccacagctcccacctctaaaatctaactaccctagctgagtgcgcacgaactgctttcctaaatatttctcctcaaacgttgaggttagcaaatgttctaatcgttatggcatgtgatcaactgacaattcaagtttgtgatggtttctattatttatgatgtttcttaagccagaataggaaatagcactaaggaggttcgagttcagttttggcttctaacttagtaccaatgttgggggcatatctggacttttctgtgggaggactcattggagatagggagattccatacaggataaaactccaaaagcattcttgaggcattctagtatagtacaagtcaagtaattttttcagtgtccaatgataatttcaggaaacatttaagccagttatgtttgtcatttggtgaactcaaaatgtaatgtgcactttgatgttacctacttacctcactaatattttcaatggcttccttgacagctttgcgctgctctaaacatcaacaaaagaagtgtcgacagggatctcgatgtttaccggaacatactctccaaattggtccaggctaaggaacttctcaaggaatacgtggaaaggtaaccaacttatccgctgatttcccacttctcttactgcccaaaccctgatttgttcaatcactgatattactaacgcacgagggatgttcctaattttattttgcaacaattgtgtgatattaatagctttatacttgaagtttactgtttagcacataaatctctcctctttcaatgagcccaggcaaatggattagtttatattgccttctctttacattttgtatcctccccagtttttctgtgttaaactgatcatctcaacgagttgaactcaactttgttggcagggaaaagaagaagagagaggaaagatcagagaccccaaaatcgaatgaagctgttacgaaatttgacgggagtctcaattccatgaggcattaactcaagccttcataaggggagtgagtgctaccgtggataacagattttaacagagttctggatcacgttgagaaactatcaaggtcacctttcactgcacggacactttggctgctctcgtgtggttttgtattctgccgtataaaaggatccagattgttcttactactgagcattatattttttttgtaattctccttttcagtgttcaaatgtatcgttttccttttctttgacaatatatgaagaggtatgtggggatcaatgttactcacaagatgaaaaatatattgttcagttatctcttcatgatgaaaatgaaatcggtcacaagttctttctttggatctgtatgtatcaggaatatcagtggtggaaacgagcaggaagacttttctgcattggatcatatgccagaaaatctaggacttgtttggttgggttctagctctagattcttgttatgtggagcaggagccaaaccaaacactcctagatcctcctaagagtggagtggatggatctgcttcacaaaatatatatgaagggtggagctaccattttctagtttcacaacttcagctccatattaagtttttttttttagctccatattagacttagagctctaccaaacaagttagtaatctgtaaataaaatgtaccttacaacctaccagaaataaattgccctaaataatccaagaatactttaagttaattgaaacattagccgtttgcatgtccatccaacatgacagaaattgaagcaatcctctcccaaatttgaactgcatgaattcaaacggcaatggcgtggcgattctaaaacttatagatttctttttcccttcttggatgccatcttttcaaataactcgccttcaactgaattgattggcaaatagaactcttaatcttggcagtgtatatccataagtggatataaagtccggatttctatccataatcttaagataaaaatgaaactcttgagtcttgacccaacatataaaatttgcgtgttccaagaagagctttacaaactccattgtccattcacagattgctgcattgtgatttcaggactgaaatgctaactcaacttacaaaggtgccagagctgcaaaacagccaaaagatttattttcgcccgatattttggggcccatccaccctgaagaccacaaatcacaaagcattccaaaacccccatcacccaatcccagccctccacgtgtcaccaaccccatggcaaacctccccatccatagggccatacagataaggcccggataaggcagagccaaccgtggccgtcagatagatcacagccccctt

SEQ ID NO: 892 - DNA, 14552 bp, Oryza sativa; identical to SEQ ID NO: 524

SEQ ID NO: 893 - DNA, 4829 bp, Oryza sativa; identical to SEQ ID NO: 646

SEQ ID NO: 894 - DNA, 4792 bp, Oryza sativa
taacctactactagaactgctaccatccgatctttttttgcccgaatcaaaaaagagagaaaagagaaaaaaatatgcttttatttttctcagaagaaaaaaagaggggtagagctgcatgcgcacgaccatttcgcgacggactaacggtttgttcaacacctgtcattcccatcatgagcaggttaagcatttcggcacgcattcctactttgcaacctgctttagctagccgcggtcagtgataccggcaaaaattcccaagtgatgtttacttcgaaaaaatagattattcacgcatcaataaatcataaaatgagtatcttacgatggactcaggaacaatcggtagatgtgtttaccgacaaaaagaaaaaaaaaacaccgccgcaccggacaccaagtaattaagcagaacagtgttcaggccagtatgatggctggttggggatgatcagaggaagcggccaaaggagagcagcattataggagcaggagcaggagcaggagcagcagcagctgctgccggggcagtacgtagtacgtacgagagcgcgtacagtagctgatggtgtggaaacagggcggaaagggagaggtgagctggagaaagggatgattctctcgcgcgctggccagaagagaagagaggcccatttagctatcactgtattggttaaccggtttaaccgatcagttgattaatccggctctctcgcccgcacgcctttttccctttatttccgtattgattgcgcaattattcggcagcgtctatctgtctctctcgcgcgcggaggcacccagctcggctattctagcgcgtagtggtggtgctagctactagtagtagtagatttttgggcagcaagcggccgcagaaaaggagagcgaaacggaggagaaaccgggaaactcagctcgcggccaatctataaatagctgccacccctctcgcctttccctccacaccccccccaacaacaccaccgcccatttccctttctcttcctcttcttcttccttctcctcctactcctctgcgattgacaaagataagtgaagtgagcaggcgccaatgggtgcttttcttctgttcgtgtgcgtgctcgcgcctttcttgcttgtctgcgccgtccgcggccgccgccggcaggcgggctcgtcggaagcggcggcgtgcggcctgccgctgccgccggggtcgatggggtggccgtacgtcggggagacgttccagctgtactcgtccaagaaccccaacgtgttcttcaacaagaagcggaacaagtacggtcccatcttcaagacgcacatcctgggatgcccctgcgtgatggtgtccagcccggaggcggcgcggttcgtgctggtgacgcaggcgcacctcttcaagcccaccttcccggcgagcaaggagcggatgctgggtccccaggccatcttcttccagcagggcgactaccacgcccacctccgccgcatcgtctcccgcgccttctcccccgagtccatccgcgcctccgtcccggccatcgaggccatcgcgctccgctccctccactcctgggacggccagttcgtcaacaccttccaagagatgaagactgtgagttcttactgcctaactcctcttcccactctgctttgctctgctctactctgctttgctgatcgatccgatgtgtttgttgttgatggcatatacaacagtacgcgctgaatgtggcattgctgtccatcttcggggaggaggagatgcgctacatcgaggagctgaagcagtgctacctgacgctggagaaggggtacaactcgatgccggtgaacctgccgggcaccctgttccacaaggccatgaaggcccggaagaggctgggcgccattgtggcccacatcatctctgcccggcgcgagcggcagcgggggaacgacctgctagggtcgttcgtggacggccgcgaggccctcaccgacgcccagatcgccgacaacgtcatcggcgtcatcttcgccgcccgcgacaccaccgccagcgtcctcacctggatggtcaagttcctcggcgaccaccccgccgtcctcaaggccgtcaccgtaagttcgcctcctcatatctcatagtatatcaaagtccttgatggtgaggctgaccgcgggtgccatggatggaacaggaagagcagctgcagattgccaaggagaaagaggcgtcgggcgagccgctgtcatgggcggacacgcggcggatgaagatgacgagccgggtcatccaggagacgatgagggtggcgtccatcctctccttcaccttcagggaggccgtggaggacgtggaataccaaggtgagcagcagagcagagctgtccggtggcagcctgtccgtccctttcgagacagcctcgcgcttctcttccgctgcgagtgaactggaccgaatggggcagactggttccttaactgaaatagactaactcgatcagtcgtcccagaatctaacctcgttcgatcgtctgctctgtgcagggtacctgatccccaagggctggaaagtgctacctctgttccgcaacatccaccacaaccccgaccacttcccctgcccggaaaagttcgacccgtcccggttcgaggtcagcatcacgaacccactcttccgtgtttttgttcccttccctccctttcctttcccggtgcggccgacttcctagccaagtcggtccgcggtttgcgagcagtggccggtatgggttttcctgaccccgcgtccgtcccgtcactgttgcaggtggcgcccaagcccaacacgttcatgccgttcgggaacgggacccactcgtgcccgggcaacgagctcgccaagctggagatgctcgtgctcttccaccacctcgcaaccaagtacaggtggtccacgtccaagtccgagagcggcgtccagttcggccccttcgcgctgccgctcaacggcctccccatgagcttcacccgcaagaacaccgagcaggagtgaaaaccgaacagggagacaaaaagaagaagaagaatactagcatcagctaagctggggaaagctggcaaaaccaacatcaacggcgggcagcggcgccacgcagcgcgcgcgagtccattttcgcggcggtcaccgtccggggggacacctgttggcgccgcagtgggagcgggagaccgaacggtggattccgtattagcacggatcatcagagtccttgtacagattcttcagctaggaccacggttggcaatcgagaggaggagcagaggagttgatgaaaaaaaccaaacactacgtagacatctgagctagggagcgccacaaagaagtggcccttaattgtaaaaccaaccattttttatccttttttgcttagttttttttttggccaacaactataggagaagagtagagaagagaagagaaattggggagaaaatacagggaggatgaagaggccctgattgggatgtaagctaggttgcccgcctgaaagcaggctggcatgcagatgcagctataggtcgaataatcgaggcgagcgatgatggacggatggatcgattcatcgatcgccagagtcaaaagggaagaacgtcgtgatcccccgcgggctaagccaggccacgggagagcgactcctctgtaccgtttcgtccaactcaagagaaaatgaccttcttgagaaaagtattgaattgtccctatacacgcgcacacaggaattgctacccagcaccctatattgcagttgagcaagcgattttttcgatcacttcttgtgtgtaagcatgcatgcatgcttccaataaactaattctaatctgcagcgtgatccataaaaatatcggttggactttgggataggatactacccgagtcaaactgatggaatgatgcatattgtggatgatgagttcttttaaaactaaactaaaactatctgttgcctctctagcactggaagggctagctctttgtaccacgtctgtgatccatctccaatcttaaggttctagaagctaactttggatgccaatggcatgttcttgattctttttataaaaaaaatgaatatggaattaggagatgattgaaatcaaattgttactcttggtctaaatgttggctccaaaacaacccaaatgcactatgatggtttaacccttcaaaatatttcattttgttaaaaacaaccataatggccaacaactactaagattgtagcgggtaatgttgctcccattgggcacggtggcattggtcaagcgtcgatgaattaggccaaggtcgcgtggaacaacaccctagggaattgaaacaacaaatataatgttggcatcacatagaattcaaataaaatgtggttaatggagttatgaaattcttccatcgtgtattcgtgttgctatacaatcatatacgcatgggagattggatgagaacaggataagtatttttcacctcggacgaacacatgcaatttggttcccttgatagaagttccagttgatttatagaggtatcaaaaatggtttacacttaaactcacctacttatccgtttaccatgttagctgccaaggggtgaaatcaagtttggtacgtcagctcatcgtatttccgtatcttagcccatattttctttcggagttagaaagtatggatagagtcaataatctatcactcagtaactcgtatcctatttcatatttgttgtttagataatagtaccacatatctatttttctctctaatatcatccccacgtttcag

SEQ ID NO: 895 - DNA, 8206 bp, Oryza sativa
caacagcatattatcgtattttgtgatccaaaattgcatttaagtaagcatatacacagttaaagtcaaatacaacaacaaattcatgtccaacaaattcaaggaagaatatacatagttaaagtcaaaaccaacaaccaaattcatgtccaacaaattcaaggaagcatatacacagttgtagctgaatccgcgctcccaccaccaccgcgcacaccagcaaccgccgacatcccgctgccaccatgtgccacagcagaagccacctcccaccgccaccatgcacagcagcagcagtcgagtcccgtcgccgccgcgctcagtagcagccacggccgcctcccaccgccgccacgcgcagcagcagtagccgagttccgccgccacgcgcagcagcagccgagtcccgccgctgccgcatcagcagcagccgcggctgcctcccaccaccaccacactcagcagcagccgcggccaagtcctgccgccgccccgctcagcagtagcctcccaccgctaccccgcgaagcagccgcaactgactcccaccgccgccatacgcaaccaccgtctgcgcggatcccctacctccctccacggcctgccaccgtcgccggtgctccctccctccacagccggcaccgcagcagatccatgcccctccctccctccacggtccgccgctgccaccggtgctccctccctctaccaaccggtgccaccgcttactaccgtgcgttgccgccgccactcgccgggggaaagagagaagggatacgagagagagagaatgatatgggatgggatacacagagatgtggataaggttggagggtatttcggtcactacgaaaatttattatatttatttttttaaaaaaatgattcttaacggtgttgtagaagcagggtcagacggggtgtttgttttcaaaaatcagggttaaatagtagggtcaatttgatagatagatttcataatagggttaaataagcaattgcctctcaaattaaaatttaaaacccaacaaattgtaaacatactgcctcaccagtcacaaattgtaaacatactaccacctcagcttgctaggcgtattatattagctggaatcgaactcttccacgaaacgaaacctccaaagtttttatacacacgccaaagcaaccatccgattacagtttacagattttaatttcgaaggagagagaaaaaaaaaagaagggagagctcgcagtcgcagcgccggcggagggagaagacacggcggcgatggcggcgcgggcggaggcggcggcggcggcgccgcggccgctgcaggcggcggcgatcggcgtctgcgcggagacgggcttctgggacgcgctccgccgcctcaagctggacgtcctcggcaccgacgactcccccatccccatcaccggtgcgaacccctcctcctcctcccctacctttgcttttgttgttcttagttccgatgttttcttccccccgaaaacctgccgtctcgagcggggaacgggaagcgtgcgtatccccgcgtctcccaggcttcccccatggaattcggacgcggtggtggttcgtcggagcgattgttaagagccgtattgtttgcttatgggtggcgatgccgagtgtggatgcttgtagattaggggtttcgctcgcctgagttggtggtttgtgagcggaatattgtttagggagaggttgcggcgatacgaggttttcctgaatgccacattgagttggtctccgtgcgggagttcatgattttgtcgtcgtaatgggtgtatagtaatttggattttagaacttcttctgttgtttaatgatcaatttctagcccgaagccctactgtttgttgtcattactgattgctctttctgcaatattgctgttagcacccaaacagtgatgtatttcagattgtctgttgagaatcctaagagaagtactagcaattagcaaatataattcaaattttgctaggtcattttggttttttagtttggtcgtccatgtgttgccgtgtgaatggttttttcatggtttgatttctcaatcaactgaacaagtttgctgaactttattgctaggttattatactccacgccaatatgagaaaattgcaagcctctttaggatatgcccagaatcgatactgccaccttctgccaattcctttggcgataggaacaattgtccagtcccagggaccctactaaacactaataacatgagaggattccaaaacttggacagagcacttctactgaaagctgaagcaaagaaggtacatgcttgacatggaattttgctagcattaccactaacactactagtttcttaaaaaaaaattaaagcatgtaatatgtgttgcagatcttgcatgatattaaatctggcaaagtagaagagaatcctgctttgctactaaggttccttgtgatatcatttgctgatctgaagaattggaaagtatattacaatgtcgcattcccctcgttgatttttgactccaagataactttgctcagcttgaaacttgcctcacaagtgcttaagcaagaagaggtcatgttcctttgaaccttatagaattacagttgacaaaagatttttcttgttttaccatttccttgttggcactaaagattgttctatttctgcaggcaacatccttgtctaatgcatttactgagtggcgtaaatcaagtgaaacaacaggtttgagatgaatacctaattgggattgttttacttggttatgtcacttgatgcctaaactgtattatattgaaatttctgcagttgttccattctttctgatcaatatatccccagattcatctgctactataagacagctgaaggattggaaagcttgccagggcaatggccagaaggtctgttttgtgcaatacattttgtcatttcatgttttttaccagatgagttctgacaagtgatttagaagactccttatttacctatcattcttcatgcatacctttaatttcatgtgctaatggttgaatttgctgatgcagttgctattcggattttatgatcatggtaatcgaggttttcctggatgggctcttagaaattatattgcattcgtgagcctgcgttggaagattgagaaagttcattttttctgctaccgagaaaaacgaggacgtcctgacatacagcagtcccttgtcggcgaagcatcatttccggcacctcatggtaatttcgtacatctgagaaaaaaaaatagggggaggggggatcctatcaaaataactagtaattttggaagcttttaaagctgacactggttatgctttgtaatagcaggctgggatgaacctgattatgtgcctgaagcaattggatgggaaggagaaacggccgggaaggaatcgaaagagatgaaaccgaaagaaattgatctttcttcaattaatccagcaaggtagattaacatttttttctgggatttggaaataatcagtaattgattgaattacctttgattgctttaataagcacagtcaagatgaagaaaaacagctgatgcacttgaagcttatgggatggcgccacttccctgtgaatcttgacaagttagctggggtccgttgtcttttgttgggtgctggaactcttggatgtgaagtcgcacgcctacttatggttaatgcttttagctgacacaagatttatgttccatttttatggttaatcataacagggcatttaaatgtgcgtatcttttctgctgttaatttatgggtttttttttcagacctggggtgttcggaaactaacagtggttgatgatggttgcgtttccatgtctgatctagtcaaacaatccctctacacggataaggattgtggtgtcccaagagtgactgcaatagtcccacatctaaaagaaagatgttctgcggtggtgagtctttgcagccttatcttaaaatctatgttgtttacatatttctctcatcggtaacaattgctatcatgcaggaagttgaaggcatccaaatgggaataccaaagcttgagtataatatttctgccagcaaaatatcaagtattactgatgattgcaagcgtctccaaacattagttgattccaatgatgtggtcttcttgttgaatgaaacatgggagggaatgtggcttccaactcttttatgtgcagacaaaaacaaggtaaatcgtagacaaccactctgtaattaaggaccttttgagtagttctcataagagagaagtgaatatcatgcacttttaggagatcaggcttgagtggcaaatctgtcaatagattgaccatgcaactcagtttagtattcttcgccttccatttttcatcacatagagtgcccttgggagttggaactaataatgagttggctccgctgcagattgccattactgtgttgttaggatatgacaattaccttgtcatgcgacatggtgctggtccaggaacaaaaagtggaggtatggatgaagggattgctcagatagagaatttgtccacacaagacgctctcggtcggcaaagattgggctgctgtttctgcagtgatactacttcccttgttaatgtataactgtggaaaattactttatttgtgttttatcgcgtgattttgcatttatgacataattttggtatgcttaatcttattctttgcagtcagatcataatggagcactggatcagcagtcggcagtaatattacctgggctgacctcagttgcatctggcaaagcagtggagctctttgctaggatgttacatcatccagatgagtaagtatacctacatgaaagataggtgtaaagtgcaacatacatttgtatagcattgtctgtgatagttgaatagttggttgacctagtacatgagaacataaaaacaagatgatgccttatagaattttacttcttgtagaattcatgctccaggagatattgctggtacagacactgagcatcagcttggtctattgccacatcagatgcaaggatcgctctcaaagtgtgtcttgtcaactgtgctgtgcaattcctcaagcaactgtattgcatgttccaatgctgtacgtaaagtagaacatatgcaggactaaattctcataattctatttattctaatgtttctgcatgctattacaggttttatcagaatatagaagaagaggatttgattttgtaacgcaggccatcacctgtccaacatatttgaaagaccttacaggcatatctgatttgaaaaaaccatttgcttctaaaatttcagccagcattcctgtttctaaaacttcggccagcattcctgtaaacctagagaagctgtccagtgcccgatgtctacttttaggtgctggaacacttggatgtgatgttgctcgtattcttatggttagtctttgtccagttctacttttatgttgaactacgaacagacttaacaaaacatttctttgactatggtggaaacaaaacttttcaggactgtggtgtgcggaaactaacagtagttgacagtggtcgagttgttgtgtcgaatttggcaagacagtcactctacacatctgatgatcgtgacagcccaaaagcatcagcaatactagggcgtttgaaagagagatgtccttcagtggtaaatttcaattctgttccttcaaagcaatcttcattttctcacattcttgctccctttcatgtctgagcatatttcccttgtaggatgcaaaaggaattaaaatggaaataccaatgccaggccatcctgtatcacctaatgaagcagtcagtgtgcttgaagattgcaaacgcctccaggagttggtatcttctcatgatgctgtcttcttgctgaccgacacaagggaaagtaggtggcttccaacacttctctgcgcaaatgaaaacaaggtaattcttgtgtgtattcttcactaatgtagacttgtgaagtgttacatgataatatccctcgcaccgcagattgctattactgcagcattaggatatgacagttaccttgtcatgcgacatggggctggtccaggcacgaattgtggaagtccagatgtggttgctgctgctgatacactgtctgcagaagatgttcttggtcgtcagagactaggatgttatttctgcaatgacgtcgttgctcctgttgatgtaatgttgcctaaactttggaaattatactctttttacttaacatgctacattctgcaactgtcacatcattttccttaaccatcttgtgatgtagtccgtgtccaaccgaacactggatcaacaatgtacagtaacacggcctggattgtcctccattacatctggctgtgcggcagacctcttcacaagaatgttacatcatccagatgggtaagtgactggatacctgaacataatatgaacttgcgcgatatcatttccagggaaaatgttggcggcatttggtgattgaaaaaccaactgcatttaattgatctttactacattctgcaggatccatgctccaggagagattgctggcacaagcagtgagggtccacttggtctattgccgcatcagatacgaggatcactctcgcagtacaacttactaaccctattgggctattcctcgagcaattgtaccgcatgttccaatgcagtaagtaaacatttatgattgcatgatttggaacagtttctttagaacttctttcttgtattgtattgcttcttcctcatgtgatttggtgcaaaatattgcaggtgttgtctgaataccataggagagggatggattttgtgatgcaggtgatcaacgaaccaacctatctggaagacctcaccggccttactgacttgatgaaatcagcggcctattctcaggtcgagtggattgatgaagttgacgatgacgacgagatggatatatgacgtgttgcatgttttttttttcatgatgttaacacgtgtaaatacaattcatacgcatacttagtccatcagacgatgagaatggcgttcttgaatctcgaatagcctcttcttaaccaactagcaaatcacagtgtaaacattaccaatctctggtgcaacaaacaattgtaacctaggggaaaaaaatgtacactttgctaatattcaatgctaatgttgttcccattctcaattccaaaagagaacgttgtccccgtgttaaatcgcatcgttttctatgtttctacgcttgctggagctgcaccgtcgacggctgcatgcgcctcgttgtgccgcaagtactcggcgaggcagaacccgaataacgcagaaactcccgcgacgtcggcgcccatgaccagcaccccggcgacgggggcgacggcgacggcgagcagcgcggccaggaagccggcgccgaagacgagcgggaacgcgaacacgagcgcctccacgggcacggcggcgccggcgccggccgcgaggttctgcgtgacgtggtacgcccagaggtagagcaggaggcagagcacggcggccagctccgacgcgagccacagcggcgagccgccgtagctcagcagcatgagcgccatcgtcgccgccaggagcagcgacagcgagcacacgaaggcgtgcgcgttcgcgtgcgtcctctgcttcttcctctcttccgcctcctccttgctccggtcgccgtaggcgatgccatcgccgtcgccggccagctgctgcttctccttctcctccatctcctatacaggttggcttggctcgagttgtgcccgtgcacgagctccttttattgctccgagtccggagctgagctcgagtcggattgcatcccgacttactctacggattcggtggcaaaaataactttgaagctttcagcagaagaactggacagcaacagcaaaagaggaggtatattgtgtatccatctgttcttttatagattataacaagatagttactagctctctgtactgtacagcaactcatgtgccggcagaagtcacaactgatggaacatggaaaatcaaaggagcaatttgagtaacatgtggtatgtacaagatacatgattcacccagctgcctgaaagtctccgaagtcgtcgtccacgctctcttgaggggccttctctgctgcagttggttgctcctgaggagcagcttctgctttcggtg

SEQ ID NO: 896 - DNA, 3739 bp, Oryza sativa; identical to SEQ ID NO: 610

SEQ ID NO: 897 - DNA, 4665 bp, Oryza sativa
ggaccaaaatgtgaaaaatccagttggcaccacaggactctatctgctgctgctgctacttggccgatcacgttttactgccaacagaatttatggtttaattatgttttacttagcatgatgagacaaagtttttaagtgtagtactaggttcagagagagagtgttggtgagtttaattacgccctgatttgtcgcctccaagcgcaatcgacgagaccctttgccgccgaccggccgggcaccgcagcgaattacgacttgggagggcgtgctggccttgtctgactgtcctcgtacgcgaacaagcctcagcgttcgtcccttgtcgacgatggtcggtggtgggtcggccgatggcgctttgtcgatcacctcggcgctcactcagcacgcgcgtttcgcttcaattctcacacacgagactgtccgtacgccggggctctcgtgttgtgccagcaccgaaggtttagtacgtcctgtatctcgtccctgtcaatgtctgcggcgccggcggctgcggtgtttgttactgtgtcccatgcaaacaatcttggtgatgagaaaccttggtagtatcgttgccaaggagggggggtttatctccccgggggaacagaacactccagggcgcaagtaccgaccgccgccagcgccaggaacaacgggagactcgatcgtgagtcgccactcgatacactagtaaaatataaaatccataatccacaatccaagctgtgcaagctgaacagcagccaaggaggagggaggggggagatcgagcggggggccccctcgcgagtcgcgggtgttttactcgcgtcgcgcggtcgccgtccccgcgtcgccctgcctccccccggagcgcaccacgtgggcacccaaccccctctcccagcccaaagcaaattctgtcaacttcaagcttgggaggaggaggagagttggacccctccccgttcaaaccgcccacgcccccgtccccaccatcactccacccccccccccccccccctccaacttgccaatgcgcctctccctacctcctcctccgtctcccctgctctcctctgctccgttaactctatatatacgctcactggctacctcccctcccaaaccatccaaaccgacgagctctcttcctctctctccagctcggtctcacacacactctctctctctcggcagaaacacaccacgatcgcggccaaaacccacgcgattgtagctcagattgttgtgcgatcgacgcgatatggcgacgatcacgacgccaggatatgctcacatacagcggcagcacggcaggtgctcgacgacggcgggaaggcgtggggcgtccaattcggtgagattctccgcgcgcgcggttagctccgtgccgcacgcggcggcggcgtcatcggcgccggcgttcctgccggtgccgttcgtgcctggggccgacgcaccgtcgccgtcggggaagagtgccattggcgtcccgaaggcgccgaggaagggggaggaggggaagaggctcaacttcttccagcgcgccgcggcgatggcgctcgacgcgttcgaggaggggtttgtggcgaatgtcctcgagcgcccgcacgggctgccgagcacggccgaccccgcggtgcagatcgccggcaacttcgcgccggtcggtgagacgccgcccgcgcgcgcgctgccggtgtcggggcgcatcccgcccttcatcaacggcgtctacgcgcgcaacggcgccaacccgcacttcgaccccgtcgccgggcaccacctgttcgacggcgatggcatggtgcacgccgtcaggatacgcaacggcgccgccgagtcgtacgcgtgccggttcacggagaccgcgcggctgcggcaggagcgcgcgatggggcggcccatgttccccaaggccattggggagctccatggccactccggcatcgcgcgccttgctctgttctacgcgcgcgccgcctgcggcctcctcgacccgtcacacggcaccggcgtcgccaacgccggcctcatctacttcaacggcaggctcctcgccatgtcggaggacgacctcccctaccaggtgcgcgtcaccgccgacggcgacctcgagaccgtcggccgctacgacttcgacgggcagctcggctgcgccatgatcgcgcaccccaagctcgacccggccaccggagagctccacgcgctcagctacgacgtgatcaagaagccgtacctcaagtacttctacttcgcgcccgacggcaccaagtcggccgacgtcgagatcccgctcgaccagcccaccatgatccacgacttcgccatcaccgagaactacgtggtggtacccgaccaccaggtggtgttcaagctccaggagatgctccgcggcggctcgcccgtggtgctcgacaaggagaagacgtcgcggttcggggtgctccccaagcacgccgcggacgcgtcggagatggtgtgggtggacgtcccggactgcttctgcttccacctctggaacgcgtgggaggaggcggacaccgacgaggtggtggtgatcggctcgtgcatgacccccgccgactccatcttcaacgagtccgacgaccgcctcgagagcgtcctcaccgagatccgcctcaacacccgcaccggcgagtcgacgcggcgcgccatcctgccgccgtcgagccaggtcaacctcgaggtgggcatggtcaaccgcaacctcctcggccgcaagacgcggtacgcctacctcgccgtggccgagccgtggcccaaggtgtcgggcttcgccaaggtggacctcgccacgggtgagctcaccaagttcgagtacggcgagggccggttcggcggcgagccctgcttcgtccccatggacgccgccgccgccacgccccgcggcgaggacgacggctacatcctgtccttcgtccacgacgagcgcgccgggacctccgagctcctcgtcgtcaatgccgccgacatgcgccttgaggccaccgtgcagctgccgtcccgcgtgccgtacggcttccacggcacgttcatcaccggcgacgagctcaccacccaggcctgatccatcgatcgaacacctccacgtttcttgggggggggaggaagtgaccagagggagcctgaccgataggtccccggattccacccccccccccccccttcccttccagatacagttacagttacagttacagttagtatagtagttagcctcggtcttccaatttttagctcactcgcgtcagctgagtccacactagtccaatagagagagagattattagtccaagatagagagagagagggcccagctcgtagcttttgtgttgggtgctcgctttgcttccagtgagcaaccaagaggtccagagctcagccggtgcctatctaccagattactagtagtatatatgttttttttttcatctttttcttccctttttgtttggattagacagggatatgccccctgccccgggttgtcgtcgtcaccactgtgcagagtttgggattcttgctccccacccagttgctgctcctgctgctgaggtgttgttttggcttatgccaccctcccgagtgtgtacatttgttcatagcttgtataataaaatctgcctctcccattggtttccatgtcattttgctccgccaaattctgtctcttcttgttggactctgctgctgctgggctagctagctgcagcgacagctctgttactgtgcacagctctgtttatacatcgcaagtggaagctctgctacttgtttcttccatcactctgctagtgtggcttctttcagagctcagaccacaacattatctaaattttgatttcttttcccacttgtaattttacttcaggccactgttgtctgccggtacaactagctgcgggttagtacgggctgtggagttggcttccaagtggaatcggttgagacgaaaatttcactggcatttggattgtgcctgtgatttactcagattttttttatgcagacaagaatttttactgttttctagatttgagacatggcaatatggcatcaatcttgtggcagatttgatttgtttcccaaggtgatacatccgccagacataaccaaagtcccagtctggcatgcattgtgttgaacttccagagcttttttttttttttcagaggagaattcagagcagagaaaagatgcaacacatgcagagagatgtttcagcagcatgaataatgtgagtttcgagctcttgttagttgcagaagtttggcacctcgacgagtcatgtcgtatgctgttcttacgaggaaaacaaaaacgttctgcacgctagtgcagaacaagaccaacttcaggtcggcacaagcagggcagaaaaaagtggccttcttctggaagacgagctggtagttggctttacaacaagttgacacacagaattgtcgacaaattactggtatagttgttaaagtttttgaaatgttgtgtttgagagaagactcatgattgaagagagtaaaatcctttcagttggtaattcagactttggccgagtttagttccaaatttttttcttcaaacttccaacttttccattgcatctaaactttcctacacacaaaaacttccaacttttccgtcaca

SEQ ID NO: 898 - DNA, 4665 bp, Oryza sativa; identical to SEQ ID NO: 897

SEQ ID NO: 899 - DNA, 9200 bp, Oryza sativa
cagttatatgatgattagaaattttggattttattacatgatgatcaatttgggaaggagggagtatatacctttagggtggagatatattcttcggactaacactatgagtatatatacctctctatacctcataacaacttaaagttttgtagtgctaatcataaacttatatttttcaatcagttaaactagtttaatttttttacctcatatattatgagaatgtatatacttttgcaatggaagaaaacctcaaaaaacaattccctttagaattaacggtgagaaggtcccagttcaaacgttggacatgtaatctcaatatatatgagtatttagttctcaattctgaataaaatttacatttgaaacacgaccaaagagccaataattagcttgtctaggcagttggccaagcttaacaccgccgcaataaaattaccatgatactaatttttaagacgaaaaccacgtaccataatgtaatgttataacaaagaaaaatctactccattgtaagtgatacccccatgaactgtgttccacaatattttgatctccaccataagtctttcaattctctaattatttgatatatgcctaataaaccatgaaaaaaataaactaagcaaccaagagtaatttattagcacaaacattaacagtgttcatagcggattaaaagccaatgctaaaaatattacaaactttaaaataaactaaaaattatgtttcaaaatttaaattttggatccagttgacgacgagagactagcagtttactgctttgaatactctggtaaaaaccggtgcaccgctcttcttctacaaatggacaactaggttttcggctaccgttctacacggccacacatggttagccacccagcggtccgcgcacagaagatggtgagaacctggcaagataaaatcctgagccagcgtcatccgaccttccaaatggaatcaggcgattggctgcggttcctcctccctccaccaccacaccaccaccggtcgcctactcgccttcgccttccctcctctcctcccttccacgaccgcagcccaaaacttctagaagcaaccgccgcgagcttaactgctagtactactaacacctcacctacctccctcccccgccattgctccgtctccgctacacgcgaagagcttcacctgactctcgcttgacgtgctagttagtagtagctctcgatcgaggcgcggtcgtccgtcgagggcgcgtggccatggcgctcctctccgcgaccgcccccgccaagacgcgcttctcgctcttctcccacgaggaggcgcagcacccgcacccgcacgcgctctcggcgtgctgcggcggcggcgccagcggcaagaggcagcgggcgcgggccagggtggcggcggcaatgcggccggcggacgcggccgcctccgtcgcgcaggcggcgtcgccgggcggcggcggcgagggcacgcggaggccgcgggtgctcgtggccggcggcggcatcggggggctggtgctggcgctggcggcgaggcggaaggggtacgaggtgacggtgttcgagcgcgacatgagcgcggtgcgcggcgaggggcagtaccgcgggccgatacagatccagagcaacgcgctcgcggcgctggaggccatcgacatgtccgtcgccgaggaggtcatgcgcgaaggctgcgtcaccggcgaccgcatcaacggcctcgtcgacggcatctccggctcctggtacgccactcccctccccttcccttctcttttcccttttcggatgaaaccatccggttgcatcagactccagtgagcaatgtcttcgtaagttcgtactcgtacagtcgtactgcaccacagtgtaactaaaaacattcatttcagtcacgccatcgtgtgtttaattaacgattctgaccataattaagggcttaataataatcacctcgcggctgcaaccctagcagtcagactatgagtcctgaagggtgtgtttagttctttgggtgtaaaatttttaaagtatacagatacattcgaagtattaaacgtagactaataacaaaacaaattacagattatatctataaactgtgagacgaatttattaagcctaattaatccgtcattagcaaatgtttactgtatcatcacatagtcaaatcatgacgtaattaggctaaaaaattcatctcgcaatttacatgtaaactgtgcaattgattttttccccacatttaatgtcttatacatatgtccaaacatttgatgtgatgttttggccaaaattttttggatctaaacaaggccatgtagttataattttgatccacgttttaataccaaaattttactctgaatcatcctctaactaatattttcactttagataagattatcgttgttgtactttggatcatctaaatcatttctctggctgcatctaccatctaatcttgcaaagaatagcctatatgtatgtcaggaatattatcggtttacatgtaccgatgtagttaaaattatttatacgctcgagagaagtttttgaggtggttcaaactaaaataaagatagctaaagtgaaaaaatcgtttaaaagacactacgttcaaagtgatttttttaatacgggtgaccgtaaacgtattttactcttttgtttactcgagtctccagcatgttacttgtgcagttgctaggcgcgccgctgatctcacgaacacacgtggtgcgacgccgcttaggccaggcgacccacgttggagccgccccaccagccacggcaaattgaaaagaaaaacacctggttagagcaagtttaacagtatagcccactactatctccaaatcatctatagccaatgtaatagctaattcatataatagggcttactatactatcaatagctggtcccatttgtcataaatgtcttggagcctgtgctgcagctctgtagtcaactactcttctctctcttcttttatctctttaaaatatgtttatagctggtttagagcaggtacaatagcaggctataagctaaactataaatatattttaaagagataaaggaggagagagaagagtagcgggctatagatatgtagccagctgcagtacgaactctaagatgtaatgtgggtatgataggtaggaccgggtattaatagtatagtaagcaattatatgaattgactattagattagatatagatgaattgaagctagtagtgggctatactagctctcatcagtcagctggtcggcgtcggcgtcgtcgtcgctgctttccccttctcctggccccgccggcgagcaacccgcgcccgccacgtacgcgcgtcccacttccccccaccccacacgctgctccactacgcgccgaaagggtgaaaccacccatccggcccttccattccgcggcgggtgcctccaattcgtcgagcacgagcgagtgagcgacatggcttctaacacaccaattcgtcgaacacttccgatcgtcttctctgtctccgtgtgagtattgacctcaggcgccgcgacgtctgcaagagtagtcagattcaggagatgctcgttgggtagagcggatcggagagtcactgtcacagtagcgcttctgctcttgcttctcggatcccaccacccaagaagagctttgctttgctcccgttccactgccagtgccagccatggcgccactcccaagctccagctcaacgcgggccacctctctcgtggcgatcccgggcgcctcctgcccccatggccaggcgcaacgcctgctcgccttccgtcccccacgacgcgggtcacagtggcgcgggctttgcgtgtcccgggggcgccacggggcgaccgtcgccatggcaatgccggcggcgcaggcggcggggcgcagggcgcgcgtcctggtggccggcggcggcatcggcggcctggtcttcgcgctcgcggccaagcggaaggggttcgaggtggtggtgctggagagggacatgagcgccgtgcgcggggaagggaagtaccggggcccgatccagctgcagagcaacgcgctcgcggtgctcgaggccgtggacgccggcgccgccgaccaggtcatggacgccggctgcatcaccggcaaccgcgtcaacggcatcgtcgacggcgtctccggctcctggtaaggagtcaagtcgtgccagcgttagaagcgaattgcaacacccaccaaggattggttgcgtctatcaagcctaaaattatggggtttttttttctcctttctagaagtactaagtgtaagaataatttgctggtttacactattggccgtcctgtttgtacaagttttgcttacctattgctacaacctacatgagaatcattaatcacagacctatagtttcaattacagtacaatactgtacaaggaaatgcaatttgttgcttaatcattagtgctaacttgacatataaggcaattattctttgtgcttactctgctacatttgtttgcatttgcaattctgaatgttgttgtctgcttgttggttagctttaagatgggaactcaactgctgaaggcatccatttgactgtgtcaaattggtattcaggtacatcaagtttgatacatttactcctgcagctgagcgaggtctcccagttacaagggttattagccgaatgacgctgcagcagattcttgctcgtgcggttggtgatgatgctatactgaacgatagccatgttgttgatttcatagatgatggcaacaaggtgaatgatcagtttgtcattgtggtcaattggccatatcctcagtataaaatgtgctcaaaatgttatggaaaattcttatgttatggcttttggacaagtacaggtaactgcaattttggaggatggccggaaatttgaaggtgaccttttggttggtgctgatggaatatggtcaaaggtaatgtaatcactcaaatcttttggtaacaattgacaaacataatcaacagagacgtgatttgagaatttaattattggacaggtgaggaaggtgcttttcgggcaatcagaagcaacttattcagaatatacttgctacactggcattgcagactttgtgcctcctgacattgacacagttgggtatgtagtgcggattcagatgactgctgtatttttttcctctgttaggaaatactaatatgttcctcattttcttctgttgaaggtaccgtgtatttcttggtcacaaacaatatttcgtctcctcagatgtcggtgctggaaaaatgcagtggtatgcatttcataaggaacctgctggtggcactgatcctgaaaatggtgagttcctagagtgaaacttttgagctcacaagcatatgcgggccctgtctgtgttcttattgtccactaatgctttttattggcaggtaaaaataaaagattgctcgagatatttaatggttggtgcgataacgtcgttgatctgataaatgcaactgatgaggaagcaattcttcgccgggatatatatgaccgaccacctacttttaactggggaaaaggtcgtgtcactttgctaggtgactctgtacatgctatgcagccaaatctgggtcaaggtggctgcatggctattgaggtacacaattaacttttcatgtctctgatgacactaccagcatggtggatgcatttcttgccctggtattgaaactcagcatatatacttatgttactgtggcaattttttcccacttgatttcacaggatggttaccagctggctgtagaacttgagaagtcctggcaggagagtgcgaagtctggaactcctatggatatagtttcctccttgaggaggtaactgttttttatgttttatcatactagttttacctagatagaatgtcttctggcatcgactagactttatgtcaatacggatcaaaattattcttcaaggccatcttattgtgtatactcttaattctttaggtgtgatcctcagtcatttgattgatgatcaagacattattgtgcttgtgtggctgcagatatgagaaggagagaatactacgtgtttctgttatacatgggttggcaagaatggcagcaatcatggctaccacttatagaccatacttgggtgtgggtctgggaccattgtcggtatgtcaagaacttgttctgctttgtacttctaatatctaaatgtacttatgtggtttatgcccgtcagccagttttaacctgcttattatgtctgttgctgattattttattttatttctgaaacaagtttctgatttagattatcatcataagaaaatcattgaagaatcgcagactaaaattatttggtcttaatatggatatctgtccaatgcagtttttaacgaagttgaggataccacatcctggaagagttggtgggagattcttcatcaagtatggaatgcctttgatgttgagctgggttctaggaggaaacaggtgattattgagctataacttcgattttattttgagctcacatgtagatacataatctgaaaatactcactagattggcatggttgttattactcaccatatgttaatgtcaccaatgaacagcacgaagttagaaggaagaccgttaagctgtaggctttctgacaaggtatatctctattctgtatgatttatcaatgtggggcagtgcaatattttccttttctgacttttacaatcatgctgaaggcaaacgaccagcttcgtcgatggtttgaggatgacgatgcattggaacaagccatgggtggagagtacggtcttacttgtcttcagaattttgatttcattttatgtcaaatatgctctgtataatccttcttaattccagtgcctttgagaaaaggtactcattagaacaatgctacttgcaggtggtacctcctccccacaagttctggagactcgcaacccattcgattaatcagggatgaaaaaaagtcactctccattgggtaggtctaaataataaatctgttattttttggtaacactttcttcaaggattgtagaataaaacaaaattgttcttttgcagaagccggtcagatcccagcaattcgactgcttccctggcattgcccttgccacaggttagataagcaaaatgatggcatcaaatatttgttggaacttctttcgaactataaatgcattgcaacggttcttaggtggagacattcaacagctgaattttgttttacttattactacaacctaattttctcttgcctaaaaaaatcttcagttttatttctgtcaataaaaaactaatgcttctccaatttgttcaacttcattgcagatatcagaaaaccatgctactatcacatgcaagaataaggccttttatgtgactgataatggaagtgaacatggtacatggattaccgagtaagttctgaaaaccgcatgattctttgctcttgccctgaattcgaaatggatgcatcttactaattcagtcccatgtggactctccagcaacgaaggtagacgctatcgcgtacctccgaacttccctgtccgtttccatccctcggatgccattgagtttggttcagataaaaaggtacccaaaccttactgacaccgtattgtaccattgtctcctctcattttgttcagaagaaccatttgcgttgagttgctgcaaaaattctgagttctgatcaatttctacgaacttgcaggccgtgttccgtgtgaaggtgctgagcacgctcccatatgaatctgcaagaggagggccgcaaatcctgcaggcagcatgaacgagagacttcagtcagccatggctgctgtcatcactcatcagctactgtacagcatccagtaaaacacagtgaattttgcactaaaatgcaggttccacttccagacaggattttgaatagctttctctgacggattgaaattgcagttctccatacagaaactgaggtgtacaatataaaaaaaaagaaactgaggtgtacaatagccaatagggacaggcaattttagctgttgcctgctgtatatacattgttgtgccattacagcaacaaggtggaatgtaattacggcatgaacacaatttaccaaatggaaaaaaatgtagctaaaaaccgctttgtttggtaactagttgtacttttccgaactttcttccaagcggaggagccttaccttgccacgatgcgatctgatttctgaactagaacgtcagccacaatgcgccacatgcaccaccgcagagcgccgccgccaccgccgccgccgccgcagtgttcgccgccatcgccgtcgggaaggcgaggtcatgggagtgtgagatttgggccgctagttcggcgtaagagcccttcccagccgttggatcaccattgctcggtccagatttacgccaggttaggcttgtagaatctgcgaggcgtctcctgcctggcgctagccgctaggctccccactccccgcgagcttcagccatgtccgcccgagccgccgccggcggcggtgacggcgatggcgggggccgccgcaagacccttgccaaggtgtccctctcctcgctctccgccgccgcggcggaggcggccacgttccccatcgacgccgtcaagacgcgcctcgagctccaccgcggtacagggggcagcggcgggggaggcgggggcgtcatgcgcgtcgctggcgagctcgtacgcgacgggggaatctaccggggcctctcccccgccgtactccggcacctcttctacaccccgctccgcatcgtggggtacgagcacctccggtccaccttcgccagcggtggacgagacgcgggcctcctcgagaaggcgcttgctgggggtgtctccggcgttgtcgcacaggtaacacgtctccttaaagatcagactcgtctcgctcgtttgttagcacactagatcgaactgtgctctattctgaatttctgatgggtagtactactaggcattgtactgtctgtacacattactccccaagttactcagggaagatcattttgatgtttgattattgaagttaggatatgttttttctcggtgtaaaagtaagaactgctttggtagtattacatttagaagatggaattgaactggacttggggacttgacaggat

SEQ ID NO: 900 - DNA, 12770 bp, Oryza sativa
gccgacagacactccacttgagagagggggtcctggaccatggctacgacctacgagggtcatctggtgttgaatttgtctgtacaattcaaacgacacagaactgtttagttttatcattggctctgtttggatccggagggctattaaatagccctccgaaatcttgctatttagaagtattaaacgtaaattactgacaaaacccattctataacccctaggctattttgcgagatgaatctaacgaggtatattaatcaatgatttgctacagggatgctacagtaatcagccactaatcatagattaatatatatcattagattcgtctcgcaaaatagcctaggggttatggaatcggttttgtcggtaatctatgtttaatactcctaaatagcaagattccggagggctatttaatagttcggaggatccaaacaaggccattgttgatgtagtactctgtaggctgtgtttagttcaacgcaaagtttggattttggttaaaattgaagataatgtgactgaaaagttgtgtgtgtatgacaggttgatgtgatggaaaatgactgaagtttggatccaaactttggatctaagcacagccgtactgtatgagtgcatcattctcactaccacttcacgatttttattacagcagtaaacctcctgcgaccagcggtggtgttcgcgtcattcctctttggctagtggaatctgggaaatttaactatttgccactcttgtgacatggcaattaacgatttgccacaccctgttaatgacatgtgggccctcatgtgtctatgacatgtgggcctagtggcaaatcgttaagcaacatccgtaagagtggcaaatagttaaaagcccctggaatctcgtgcgactgtagtagtacgaagcaaaaatatctgctgctctgcttgtgtcgccggccgttgttctctccccgccgcccttataaattttcgacctggcgccgaaccgacaattcaaacgcgtcatcttctcccctcccctcccctcccctccccttccgcttgatcccctctcgctttagaaatctctagacgcttctagaagtctcgcgattctcctcgatacagcctaggggatcggagctgcgtgcgtcctcgttagctcggcggaggcccggggttcgatcggagggcgggatcgctagcttacgcctcgggttccctggaagcttctggaatcatccgcattctgcaggagaggctagggttttggaagccgctgcgttcagagccactcgatccgcaaatcggttagtgctctccgcttctcgcctctccacttgatcgatcgcacatctcctcttcccagtccacactgattgcacatttgcactcgattggttccgttccagtttcgaacaatctcgaagcttctcgacgcttcggggatcgtgggggcgaagctattgttgcgaggtggtaccccaaatcgcctcctacgccctgatcggtaagcggcgcgctatggcgtatttgcgatttggtgcattttttgggtgctttgtgtactcacgctagggaatttctgcagctccgccgccgccggcgaaccctagggtttcgacgacaggatgcagaagctgggtttatcggggcttaggggtctcgaggggttccgatctctcgctggatccacctcgacggccgcgaaggccccgaaccccaagccgtcgtccgatattggagggagcacgtacgggagcttcgccaatcttaagatcacagcaggttttggtttcattttccccttgtttccttagagggaggctggctacttcgtgcgttcactgatttttccctcaattttattgcttgatcacagaaaagctggttaaggagcaggcttcagtgaagactgatctagaaatgacggtatatttttcagcgtttaccattatttatggaaattttactggatggggtatatagttcggttgtcttgtgctcctgtcacagtttcgatttctggatattaggatatatctggcactgcctttgtggaattgtggttataatgcctaatagcagaaaaactgtcttctgattgatcaatgtcaaacttgcaaagttgtttatgttagtagggctgtttcagttatataatcctggcggcatgatacatacataggcaggggtgtacctatgtgtagtctacaggggtcctaggaccccgggtagattatctaattctagctaatttatgtcatgataattagtataatcggtaaataattaaataattagtatgtttgagaccccggtaaattttgttttggattctccactgtaacataggggtagttttctattcccaattctgtcagggaatcctatcatgattttgtggactactgaaaccagcagtaggtaaaaccaatgaactgtgcacacacctggagctaccttattagctttgaatcgagtaactggtaactatgcacgcatgccagttaccaacatgtcaataaaaatcttctaccattgtaggcagttcacaagcatcaaattcttactccctccgttttttaatatatgacgccgttgacttttgttacaacctttgaccgtttgtcttattcaaaaattttatacaaatcttaaaaatattagtcatgcttaaagttcatttagtgataaatcaaaccacgacaaaagaaaatatatttacttaaatattttgaataagacgaatggtcaaacatgtgagaaaaagtcaatggcgtcatctattaaaaaacggaggtagtataattttagggctgcatgtagatagtgtggatctcatgactgtactttgtgtttgttattcctattactttcctcagaatttacaaatacacagtcgtgctgaaaattgaaacagttttctacttaaaggatgttggatgctgtatatcatcagttttcactattcagcatgacagagtcacattctggaattatgtatttttataaatttgaactttgtacctggaaaaactagaatgttttggtgctttatcctctgtggtttctgttaaacacattggagatcaagcaatttctgccttccatttcatttgtcccatatcctgagctttgaacataagcttgcgcccttccatgttcagtatatggcaatattatctttactgtagtcatctttcatggtgcaaatgttctagttatatcatggataaaaggtaaattgactcaagtcctgaacagatatatcaccatatatcatcgttttgtacaggaacatattgtacttgtttacataatatttcttactactgatgcctatgctctatataactttagcataccaagttgagaagagcaacagaacagataaatctgttagaagcaaagctccaacaagctgtcaatgaaaatgcaaagcttaaggtgaaacagactgaagattcaaagctctggcagggattagattcaaaagtttcctcaacaaagactttgtgcaatcaactgacagaaactctgcagcagttagctagtcagacagaaagaggtaatgtttccatttactcatgcatgagtgctgtatagatctaactggtgaaacaacgcattggcagctgaggaagataagaagttttttgaggagattcttggcaagaattcaaaagcttttgaagaattcaactgcctgttgcacgattcatcaataaaactggaatgtgcagaacaaatgatcatttcaggttggtcagtttcttcacgcgtcagctctagcactagtattttagaatgtctgtcaattcagtaacttgctactggagactgtagatctgctaggggatcactatctgctgtgcttctgtttatgtcatctaaaccatgattattttgcagttccatgtttcttgacatgatttgtgaataataatgtgctgcaattaggtagtaatgcttcatttgtttcattgacacagggaaacaggagatgttgcggatcaaacaagagaaagaagagatggatcagagttacaaggaacagctatatgcaagtgatactaccataagagaaaaaagtatgaatctaatactaaaaattgcatcatgactaaacagaaattaagttagctatggtgcgatagtccactgaaaattttttgtatactccattcatgtgcatccggtgtattagcacaaacaaaaagtagtaacacaactgtgtccatcttttatgcagattctctcatcaaacagttggaagattccattgaacaaaataaagcccgactgttgtatgttgactcccgtttggaatgcatggagcaagagttgaagctaaaagaagatgtttgcatttgtctgaaagaaaacctggcaagcactgaaagtgaaaagaatgacttgaagcttaggaacgagggctacactttggaagttcagaaactatccaaggacaacaaggagcttaatgaattgcttagtggttttacggttaaggtaactgagctagataaagagcacacatcaatttcaagtcatgtcactcagttgatttcttcatttgagagatatgatggaaaggttcacgaggaaaaaatgttgatgataaaatctgccaaggacaaatttgaacatctccaaaatcagtatgtaaatttgatatcagaaaacaatgctctccaaactgaaatcgaggagctgaagtccagaatcatagagctgcagaaaactcaagagattgtcatggttcaacatgtagaagaatgccaagttgctgaagataagatcagaagattggagtctgaagcagaaatttctgcctccaacattagtcagctagaaaaggtagcttctgacctagaagggagggttcaaaaacttctggaggattctagatctgctgaaaatcacaaggtttgtgtcctagcctgttcagtgacaaaacatattgctatttaacctgtaagattcatgaggtttgaattttgcagcaagagttgcttcagaagattctgaagctagaatcagataatcaggagcttctaggtcgagtgcaatctgttttgaatgagaagtctaatgatacggaatctctgcaaggagagatagctaagcgtgaccaacaggttgagacacttgagaaccaggtcaatcagctttgcagtattattgatgagaaagaacaactacacacttgtgctgtagaaagagagaagaatttagaggaacagaagttacaggtctgtgcttattagaactttaaatctcattgtaatgatctatagacaacatacaatcttttctgtctactgccaggtccaagcatcacttgctgcaacagaaagccaacttactgaggcaaaaaaacagtatgatatcatgcttgaaggtaaaaagatagagctgtccaagcatctgaaagaattatcactgaaaaatgaccaggtattacgcttctatcagctgtatcctgtatgacactttgctatatcaatcacaagtgacagttagaaaagtgcatttttgcaggcaatcaatgaaatccgtaggaaatatgaactagaaaaggtagaaatcattaatattgaaaaagaaaaggtaagttaacctcttttttcaaagttattatgctagctgttttgagtttgatcttattctctatctattttctggatgttgaaaaatatttaggccgagaagctcataaaggaaatggaaaacaaatgcaatgaaaagatttcagaaaacaggcaagattctgagaggtatttgatgtgtctaaaggaggagcatggctcaatggtaggtggtactggttggatctgtccattaaagttaagctgttttgaaaaaaaaaagtgaagtttacaattagttatgataacaatgctaattttgaaatttgaaaatgattattaataattattttaggttgaagtttgtttatttgtcttggtagcaatcatgaaaagagagctaggcaataaaagtgaataaaaacctttaaaattaatgctaaaatcaaatcctaaaattgaaaaaagctgcagtttttaagggaaaaaactgagccaagtggagccacatgcgccagtttccattggaaatgttagctctagtatttgaacaaggtgttgatagcatggatacataattgcattgtggatgttcatgttctgctatgctgcattccgctacagaggattagtaacctaaaaaggttactcaaggtctttctacgtgtgcttttaatatgctttgtccaaaacacccacttggtagttatatgtgttgcaaagtttctttgaaggtgctttaggtaatgctctccttgcctgtcttttatttaatttgcactaggcacaaaacatgacatcaaagtatgatctatcatatttcatcaatatacattgttaatgtaaatggtatttggactttactggttgatttcatggttctcttaagatttaataagtcaaaaatgtcatctgatatttgagcagagctgcagagaatgtatttgacacaactttatggccgtaggacttacacatctattctaatataattttgatgttccatttggttttgcagcagttttgagatggtatatttttttacataaagtaaaaggggtgcagtgaaaagtctctgtaaaaatatgttcctgtaaattttgagagtcaaactttcatcactatctgtagaatcctgccactaatgaatttccatttgttgaagattgaaactattgtctaaaggatcccacctctggagtggggaagcactgaacactacctcagcggaaagtctgaaattagactgtttttcttctaaaatgaccatgaaagttgtttcttgatatttaggttgcaagaattcagcaggataatgagcataaggaatcaactcttcgagcttatcataaagaagaactccagcgcatccaatctcaggctgagaatgaattgagggaggtcagtaataaattccaccagatgttttgatgatgattgttcatactaattaaatctggatcaaatatgcagagattgtcatcgctcagaaaggatcatgaaattcaaatgaaatcattgactaaaaagcatgaggaaaattgtcagaagcttcaggatgaactggagcttcagaagtcaaaggtagtcactctggtgatcttcttgttctggaaatcgttacttgaaaatatatctgaacacttttttttttcaggaggagaagcaaagagcattgttacagttacaatggaaagtaatgggcgaaacccaacaggttgatcaagaagtaaactctaagaaggtattctctgatttctatctcatatactatttttaagcaattcatatttaagttatgttatattaattgcatagcatgctaagcatttaatataaagatgcaagtgcatatgtttcactaattgaaatgctgctgcttatttcatgtaacaataaattcaagaaattgagtattttgacttggtttggcattaatttataaagccttgtggcttgtatttcgaatatgtaggtcaagacaattggttttttttccaggtttgacattttctaccacaaccattatttccttgtggattgttattaagaaaaattagatgaagattaggaatgagtcatttggttgatttgattggataaattaatggaaagtaaaggataagattcattttccatgctttttaattctttatttgatattgtcaatatattcctaaaccatacataatagagagattttaatccctatgtggtaattatgaaaacattctgttttaactttcgagttggctgttgatgcatgcaaaactttttaacataatcaagtttgttccttactctcatgtatatatatatatatatatatgactcctaactcagatatacatgactgtggggagtacttctaaaaaaactactattgtgtcaaatttctgtgcacttagttatcttttaacacatcacactttgctttccttttttattatgagcagaaatagtatttgtttcagactttatgttgtagattttgatgcgccattttggccttttatttttcattacaatcctattatttatttcatgccttgcaaactctgaacttgctgtgtttgcatataggttcctgtgtgtgcgatttggttcatctgtagaggtgctagttgcaaactagtgaaatactattgacttttttttttcacgatcttgaccatagatttgttcaacccctaagtcccagtatgacactttttgataagaataaatgaaagaaaaaacatttttcttcacctgtttggattataataccagatgttcatacatctcattcttgctagattttcccaaagagctccttaaacatatcttacaaattcaggtaaaaatggaaaatatctttaaaaatggttaccatgatttggtcacgtgctcatgttggggcagaaccagaaaggctgatatagtccatatcatgcattattttcagtttttgttaatcttataattggttctttgtaatttgtttcaccgtttacgttttgtatgtgccaatgctctccttaagagttaagacatacatattttatttttttaggaatactctgtttcatcaataaagaggagagatccatatatcagaaaagaacatcagcttcagttggttagtcctgagaccaaacggaaggtaagacatctctctttaaacgttgactttatcactgcatgcttcattgcacaaattctaaattcgcatgttctactaccaggatgttaatctatctggcattatacaatcaccaattacaaacatgctgagaaaggtagagaaaggaacccaggatattcctaagcatagaaaggtgaatcattttacatttagattcatcattctcttattagagaatgtatcaagtttcactaattgaatgaattaatctgtaaaatacatgttttcatgtgacatgttttcggtgtccttttaactaggtaacacatcatgaatatgaagttgagacagcaaatggaagaatcacaaagcgcaggaaaactaagagcaccgtcatgtttggggtacaggtttttcctctcttttttctcctttgcatttgattggtggtctagtatttcattcttgtaatcatgttaacagtagcctttttctcccattcaggaacccaacactcagaagtcattgcatgatactgctgacaaggatcctacaaaaatgaagaaggtatatttgtgtgattaaatgtgttcgccaacttctttccatatgcatgtctaaactactccctccgtttcataatgtaagtcattctagcattgcctatattcatatagatgttaatgaatctagacatagacatatatctagattcattaacatccatatgaatgtgagcattgctagaatgacttacattatgaaacggaggaagtagattcattgacctctgtaattttgttttttgtttttgggcatatagggatacttttatagaattgaaatattttctgtgtactatatcattttctgaattatgatctgtactatgtgatatattcaggaatgcctgttctcatagatgtttctgttgtaagaacatttgtagttgacttactactttgatggtacagcatacatttattagatagtgttgactcagttttattctctcgctaaatgactgaaaatttgtgattgctcatgtggtggaattcgatcagagtctatccgaaaacatgcatccagaatattggttttcccagatgcttttgctcaacttttgttaacatttacgcttcttcactctccaggttgttgctggatcccatccccaccctgcaaacattggtgaattgttttctgagggctcgttgaatccatatgccgaagatccttatgcatttggctagaaggtaatatagtttccctttttttacttattgtattttctaatagtaattatatgtctgcatgaataatccatcaaggactgcatgcaatgttctaaaatgctagagtagtgcttcagcgacttttacttttggtgaatagcattctcagttgtcagacctgaaacttgaactcctctagcaccatactgcaactttcgtatgcttgccgtccttgacttgttgtatgtcaaatgtagctgctttgcagtgtttggaaaggttgatcttccaaacaattgatccaatgaattggttctaaaatgctggtttgaactcacgaatctagaaaatgtgggttatatcaatataatacgatctggtttctggcaatcactaacgattggtcagttctgtgattaagcacttcactgcatctacatatatttgatactactggtacctgatgctttctcaagtaaccgtgcttttctgttaaaaaaaagccaattcttttatcacattcattaccaataattgttaagttttgatagtgcagaagcgtaaatgctatactccatctatttcatattataagatgtttcgacccttttttttctaaatcaaacctctttaagtttgacaaactttatagaaaaacatagcaacattttcaatacaaaacaaacatattatcaaaatatattcaatgttagatttaattaaactaatctgatgttgtatatgtttctacattttttcgtaaacttaatcaaacttaaaagaaattacttatggaaaagtcaaagctttttataatatgagaaagggagtattcacttacaacttctgaattctaatcatgcctccctttgcagctcacatttgaggtgctgaccttcagaagcatgatgatgactcccgagtgcaatccccaagtcggattgaatcaatgatcttgcggccttaggcatctgaccatcctgttgtacgaaacgacaatcgttaactgcgttgtatctgcaatactgttacgacacgggttatggcatctgaccatcctggtgttcataacatactatcactacctgtgatgtatctggaatatcgatacgacagacaacgattctcctgcgcgtacagcatcaactgaaaatgccagtgttagttttgctatttctaacgatttgcggaaggattttaatacattgatattccattgccggcggagtggacaggcaacggaaaacagtagcaaacttggtccgaggacaaagcatctagttttaatttgagcaattttaccatacaacatttggtatctcgaggtatcacattttacatacaaaattttgatacctcgagctggttggtaaaattgtttttttttttcagtttatcagtggctttttatggcttgcgcatgaaggtcctctcggacatgaatttgggccgagtgaatacaaatatctcaataaagtgcgtgtcactggattcaaagggtccagaggacaacttgagtttcttttgcatctcatggaaaatgcacctggactagaagtcataactgtggatacagctgaaagaatatggaaggatgaatatcataagaacgaatatctctgttctctgcaagactgcaactttgctcgtcagaccgccaaacaacatccttcgtgaagcacttccaccggccgcaaagatttccgtcctttagcatggatttgtgtaattgtttagtagtgagttcatgtgatctctctatatatatagtgttacatacctatcgatgatttgaagtttgagcaatagatgaatgctcgatttaaaatactctttggctggtgcaagtgtcatgcattttattcactagtacgaggactaaagggaagtcgtcgttgactcctctatagttggtactagctgttaactccttccgttatacggagtactagtaaaaattaacaaagatgagatacatgttaatactataaatgaaatgtgagataagtatgtccatattcatatttatagtacgcaatgtttagattcgtaatacaataatacatcttattctatattagattactaattttttttcgggaatacacaaaaggattgcgtacttttgtattaagagaagtaaagaattacagctagattactatattttgatttagattcgtagtacgaagatgtatactttctcgtattagattacttatttactttacccacgagctgctcctcgtggtctacactctggcagtggcaagcattcgcgaccttgtagggggtgtgtgacagcggacaggatagcaggaagcgccatggcggcaggtgtcctcgacgccggcggcgctgtcccggccgcagcttacagcggggagctcacgctctccgtgcttgtcacatgcctcgtggcggcctccggcggcctcatctttggctacgacatcggcatctcaggtctttgttcttctcccagcttgtgcatccgcgtccacgatggattgcttggattctttggtcgattatgatctctctgatggtgctcgactgtttgttccaggcggcgtctctcagatgaagccgttcttggcaacgttcttccccaaggtgctgatgaggatggccgacgcgaagagggaccagtactgcgtcttcgacagccacgcgctcacggcgttcacgtcgtcgctctacgtcgccgggctcgtggcgtcgctggccgccggccgcgtcaccaggtggctgggccggcgcggcgtgatgctgatgggcggggcactgttcttcgccggcggcgccatgaccggcggcgcggtgaacg

SEQ ID NO: 901 - DNA, 3911 bp, Oryza sativa
atgtttgttttggtcatctcatctgatgcataccttaatgtattgcacaatcattgcacggtacttcatgtgctcttcctcgttgccttcgagctggtcgcccattgccctgcagactacgatgagtaaccatataacacaagactgcataatgcatatactattcctcctttcataaactaacagtactctaacatatcgtacaacatcgattagcctcttcttgtaaaaagtggcaagaatttgagtaatggaatcgaaaagaagacctaaagaagcagttgccatccgcactaacttcgataatcttcaaccccagcgagtccagctgcgcccggaactccgtcatgtcggccttcttcgcgaacttcttctcctcctaacaaatcaatcaccaaaaggaaaaaaaaacgagaaaatatattagctaaagctcaattccccttccaccaaaaacgatccaatctccagctgactgaggcgcggggtattactgcatcacgcttcggcttccgggctttgggcgccgccacggctaccttcttcttgttccgagccattacgacacgtgcggtagtagtggagtctcgcctagatttccccgcggcggcggcggcggcgagggggaggggaggcggaatcgcagatagtatcaaatcgtactctaccagaagcccggagaagaaatcggatgggaaaaggaagaggagaagagaagagaagtcgtcaggtgatatttcgtgggccaaatgggccgggccgtaacacctcaatccccaatctgctacggcccgtgtgtgaacgtgacacgtcatcctatttagaatcgaataccgaacctgaacgtgacacgtcagatttaggagtagaaacgagtacactctacacgatacagatccaatacgagaccgacacgtcgtcagcgaccaagtaaaattcggtcacgaaccgtacgccaccaacctgtataaattcatcgaccgccaagcctctccagaacatagcacaagccaaccaaacaccgcacgatttcgtatccacacatacttctacgtgatttcgtttcgacgatctcgaggcgccgcggcgtgacgtgacgtcgacgacaaccatggcaggcggtggcggcaagtccgtagcggcggcgctggccatggcctgcttcctcctcatcctcgccgccttcgctcccccggcggcggcggcgccgccggacatcatgtcgatcatcaggtacaacgcggagcacggggtgcgggggctggagcggacggaggccgaggcgcgcgccgcgtacgacctgtggttggcgcggcaccggcgcggcggcggcggcggctcgcgcaacgggttcatcggcgagcacgagcgccggttccgcgtgttctgggacaacctcaagttcgtcgacgcccacaacgcccgcgccgacgagcgcggcgggttccgcctcgggatgaaccgcttcgccgacctcaccaacggcgagttccgcgccacctacctcggcaccacgcccgccggcagggggcgccgcgtcggggaggcgtaccgccacgacggcgtcgaggcgctgccggactccgtggactggagggacaagggcgccgtcgtcgcccccgtcaagaaccagggccagtgcggtagctgctgggcgttctcggcggtcgccgccgtggagggcatcaacaagatcgtcaccggcgagctggtgtcgctgtcggagcaggagctggtggagtgcgcgaggaacgggcagaacagcggctgcaacggtgggatcatggacgacgcgttcgccttcatcgcccggaacggcggcctcgacacggaggaggactacccgtacacggccatggacggcaagtgcaacctcgccaagaggagccgcaaggtggtgtccatcgacggcttcgaggacgtgcccgagaacgacgagctgtcgctccagaaggccgtggcgcaccagcccgtcagcgtcgccatcgacgccggcggccgcgagttccagctctacgactccggcgtgttcaccggccggtgcggcaccaacctggaccacggcgtggtggcggtggggtacggcacggacgccgccaccggcgccgcctactggacggtgcgcaactcgtgggggcccgactggggcgagaacggctacatccgcatggagcgcaacgtcaccgcgcgcaccggcaagtgcggcatcgccatgatggcgtcctacccgatcaagaaggggcccaacccgaagccgtcgccgccgtctccggcgccatcgccgccgcagcaatgcgaccggtacagcaagtgcccggcggggaccacctgctgctgcaactacgggatcaggaaccactgcatcgtgtggggatgctgccccgtcgagggcgccacctgctgcaaggatcactccacctgctgccccaaggagtatcccgtctgcaacgccaaggctcgcacttgctccaaggttttaaatttaaattttatgtttacttttaatttttagagttgattttagcgtttttataagtaatttctttttcatcattgacttttttttaagttgttaagaacatatgtaaaagttacattggccgctaatacgtgttatgtctgtgtgtgttatgtgctcacacgttgccatgttttttccttgacagagcaagaacagcccgtacaatatcaggactccggcggcgatggcacgaagtgttccggaacaacctgattcaatctcttttgtagttttgaatagggaagatctagtatagaagccttatctttgttactgttaccgagtcctttattattatcgctctttttttttcgcaagatgtataaagtcctaaacagttactgttactattactgaagttattatctatctttggatatgagttctcccaagtacagcatcacgtgttgttacagctctatcgtttgttttttagggtgtgtttagtttacgaaaaaaaaattggtatcacatcgaacgtttgatcgacgttgaaaggggttttcggatacgaatgaaaaaactaatttcataactcgcttggaaaccgcgagacgaatttattaagtctaattaatccgtcattagcacatgttggttactgtagcatttatgactaatcatggactaattaggctcaaaagattcgtctcacgatttccatgtaaactgtgcaattagttttttaatctatatttaacgcccgatgcatgtgtccaaagattcgatgtaatatttttagagaaaaaaattgggaactaaattattaataaacgttacagctgacaaatgggattgtagcttttgactgagttgacaggaacagcttcctccatatggagaaccctgtcctgaaatatcaggagaaccatctcgtatttggctcatcccaataatccttctttctataaaactaatacctattaaacacctaaaacttaacatcaaaatatactacctctgtttcaatttataagactttctagcattccccacattcatataataaatctatatatatatatatatatatatatatatatatatatatatatatatatatatatatatatatatatagattctactcattaaacacgcaaaacttataacatataaacatatagtaattatatttacaattatttcattataaaactaaatatatacatgctaaaccatcatccttcaatcattttcataatatttcagttcaaatcatttcatcgtttcttcaatatctaacgtatatattctgcagcaaagcgcgagagatcatccagtgcatgttatgcttgtgctttgaacgatagtttcagcgcaactaattgcattggtactctgtttcatggtgtggaataaaactgccatgtttagtttccttcctatt

SEQ ID NO: 902 - DNA, 4040 bp, Oryza sativa
tatttattttctttggttagtattggtgtctcatcttttttttatggttatatagctttagtcgaagcaaatgctaggtttttatttattattagaaaaatctttgtttaattctgttatactcagatttcgagtaacagtggttgtaggcttatggctgtgtttaattcaattttttttctttaaactttaaacttttccgtcacatcaaatgtttggataaatacatggagcactaaatgtggacgaaaaaaagcaaattgcactgtttgcatgtaaatcacgagacgaatcatttgagcctaattacgccatgatttgacaatgtgatgctacagtaaacatttgttaatgatggattaattaggcttaataaattcgtctcgcggtttataggcggaatctataatttgttttgttattattctatgtttaatacttcaaatatgtgtccgtatatttcaaaaaaaatttggcacacaaactaaacacaacctatatagctttagttgagcaaatgtcttgttcatgtcaactaaaaagtgtaatcgtcctccttcccgtgtgtaacacgattacacgtgtagcgcacataagcaccaaattaaatgttcatcatttaaatcgtatttatagtccattcttacttatatgggcctagcgcattataacgtagggatatattatgcaagttaaattaaacttatgataatctttttttttctcttttttttccgtagcagtagtttcttttttttggtcctttttagcgtgttgttaatctctctgcaatagcctctgatcgttgcattgtataactctagtactctactttgttttaatatattaacgtatataatacttttacgtgttggtgaaaaaaaaactaacaataatcttctcctctccgtcaaacggcggcacgacgcggcgcagtgcaaccaacaaaccggggcgggcggggcatccacaaccaaccaactccccacccccgggaagggaaacaaacccacccaagcagagcatctcgcctcctctcctctccccttgcgttcagccccttccttgcattgctttctccatgagattcctcctcctcctccatccttataagccacccgcaaccgcaaccccgggaaggaacaggaaggaagcaagtgccatcgagtgtggttgagagagtttgagacttgaggctgcgctgcgctgaacctgtcgttcggtgggaggcaagaagaaggtggtggtggtggtgcagcaatgccgcggcgcgcgagggcgaggggcggcggcggcggcggcggggaggaggtgaaggtggaggatgacttcatcgactcggtcctgaatttcggtggaggtggtgggggagaggaggacggcgacgacggggaggaggagcagcagcagcagcaggcggcggcggcggcgatggggaaggagttcaagtccaagaacctggaggccgagcggcggaggagggggaggctcaacggcaacatcttcgcgctcagggcggtcgtgcccaagatcaccaaggcaaatgcattcttgagcttcctccccacttttactgaccaccaccagctgattcttgcactgatcatacaaacttcgcataatcagatatgaacctgtttatacttacctaaccctctctcgattctctggaaatcgtgattgcttcaccggggaaaggatttcttgattccggtttgtcattcctgacatgttctgatggttggttttctctgctgttgcagatgagcaaggaggccaccttgtcggacgcgatcgaacacatcaagaatctccagaacgaggttcttgagctgcagcgccagctcggcgactcacccggtgaggcttgggagaagcaatgcagcgcgtcctgctctgaatccttcgtccccactgagaacgcccattatcaggtagcagccgctgttctcaagtagtctatgttttccatcaaagttcacacttcagagagtagtggtctgtactctttagaaccccactgtgcgtccctgggactaattctgaacaaccaatgctgcaatctggaaaatatgatcactcaacttcatacaactttaggcccagattgtttcacaattcgattacatgaagtcgcagtctcgcagacaattggcagatatttgaagctccttaacctttttcgcttaatagacaataaacacacctgaagaagggtgaaaaatctaatccttatttggtttagtagactaatgtccaacttcattgatccacagttagactagccatggacttttgtgagaatttttcaacttacattcagacagagcttgatctcagaaatgacttaacatgaacacaaaaaatattggatacagattcatctatttttctgtgacaaaatttacctctgatatctgattcctcagtctctcaacaatctacatttacacagggtcaggtggaattgatctctcttgggtcatgcaagtataacctgaagatcttctggaccaagagggcaggcctcttcaccaaggtgctggaagcactctgcagctacaaagtgcaagtgctcagcctgaacaccatatccttctacggctacgcagagagtttcttcaccatcgaggtaaactaaatatggccaaaattttcctgctacgacacaagattgcattgcatgtagatttcgctgaactttttaacccattcttgtgagttttagtcttctgataagttggccactcactcctgtctccatctgcaggtgaagggtgagcaggatgttgtgatggtggagctgaggagccttctctccagcattgtggaggttccaagcatctgagacactcctgactacaataaactcacatgactcatgttaagagagcacatatgtttctctggaagaaataattccagtagcagttctctttgtagggagaatacagtggtacatgtttgactgaatgactgatgacatagaagggggaaaaaaggactaaattttgtgttgaaattgagcacagtggcacaatgaactcgcaacatgtgaaagtttctgttcttttcatcttcttgacgacttggttgtttgattcatttattgctttcagtttaggctcttgaactcactcacccctggagaactggagatttagtaaacatgtgtattagaattaatccggtaaaaaatttcgttaatgcttggattttgtaagatctagcaaagacgaattcctgcactgaaaatcgcaaagatccatgtcgaactcaagtccagatcctagtcgaaaacggaaggggagaaagaaaaaaccaacacctcgcaggaaacagcagagacctcctccattatatcccgccggaggtacgccgccgcaacagccgaagaggcttcttctccggcaaccggcggcggcggcggcgacgaggcgaagaacaaaacgatcggggaagagacgctttgagattcgggcaaacaggtggcaggccactactcctccacgtggccgtgtggcgtgggacccacacccatcaggactcggccactcgtgtctctctctctctctctcatctctaatttttttgccccccgtctctctcagatcttctcctctctctcttcttctcttctcttctcctctcttccccgtcgccgcgcacctcccgatccctccctccgctcgctcgcccatcgcgccaggtgagccaacgcccgcgatcccaccactcctctcgagtcgctcgcttgcgagcgcgcgcgcggtgcggcgcggcgtcaccccgatcgctgtggttggggattttccgggggttcgatcggatccgtgggctgaggaaaccggggggcgttttgatctgatccgtggcttgatttttcgtctgctcttgcaggtgggctctttggacacccggtgatggatcacgcggagctgaccaccgagcaggttagttagtgattgggatttgcctcctcccccgcggggcggatttagctttggtgtgctgataaacctgttctactgtcgaattgt

SEQ ID NO: 903 - DNA, 5948 bp, Oryza sativa; identical to SEQ ID NO: 539

SEQ ID NO: 904 - DNA, 9246 bp, Oryza sativa; identical to SEQ ID NO: 542

SEQ ID NO: 905 - DNA, 3624 bp, Oryza sativa; identical to SEQ ID NO: 771

SEQ ID NO: 906 - DNA, 10541 bp, Oryza sativa
ttgcatcacccgatcttgttagcataaaattcattttcagctgatgttggagtgtcccagctctccttttctcttatgtctagactttagagtgctttattatttcatttccttttttttcttactggagtgtctcttttccaaaacacggcagaccttatttggatagcgaattcgagtcatcatgacctataaagtcaaatgcaaatatagccaaaaccaactttatggcatgatagacatgtatacaacacaacaagtatagtagtattacgtacttaaaaaaaatctaaacaacaaaggaaaaaaacaaagaaaggaagtgatttttagcgtagctgtgtttgtagcgtaattgcgtaaagtcctttcaattttgctatatctcactcgaaagattttttcttatctctcactcgattttctcactcaaatttacagtgtattttcttgtaagttacagtgtaatttatgaaacttacactgtaacttttgtaagttacactgtaatttttgaatcttcacatgtaaattttaaattttgtattggatttggtctttttcttgaggatatggtaatttaatgttcattatggtgtttcttaattgctttttgctttttattatatctatcggattttaatacaaagattaaaaatctgtgtgatacgattataaaaatctttcgaaagatgtataggtactcccaagcccttttaagaaagtttttcaagacaaaagtttttggatgaaaggtagttatagggaaaaaggaatgtgcgtttatgtttatttgcattgcttattagcaaccaaaaactaatctataagtaaatcttttatatacgtgcgcttaataattcaaaagcaaattcatgtaaaataaaatgcgatgaagaaactttaaaaagttatcaaatttagattttattaaattttagtttacaagagcgctacgatgaaggctttaaaaagatgggaaaataaaacctttgacctttctggacttcaccaaacagctcacgctttcggcttcgtgccgtctcgtcccgtgctactgctaccccctcctgaccccacccgccactccacgctcccttctcctccccttcccgtgacacacagtccccactccaccgcctccgtataagtatcccttccttaccgccggccagccacagccaccgcctcccccaccccaccccgatcccctccccgccgtacgggcgcagaaggaacccgtcttctagaaggaggaggagggctacctctctctctctctcttctgccatggggagcttcgcgaggaaggagcaccagttcctcgccgagcttggcctcgcgccgcggaaccccgggtccttcgcctgcggcgcctggggcggctcgggccccgtcgtcacgtccaccaacccgacgaacaaccaggcgcgtctccccccacacgatccgctcggttctaggcgctcgatttggtttgggccgccctggcatttttggggtgtgtgtgattgtggtggattttgatgggggatttttttttgggtgttttgtggtttaggtcatcgcggaggtcgtggaggcgtccgcgcgtgagtacgaggagggcatgcgcgcctgctacgatgccgccaagacctggatggcggtgagtttcacttgacttgctgtgttggagtgctgatatcaattcgttcggatgatgaagtgctcgtactatgctcttgtgtgtcatttgctattttctgctgcgtgagagatctgactgtgtggaaaccagcaattgtgcaattcgaaacgttgcgatattatttgtttggaaatgctgcctcaaaaccctgtaacttgggtgttttgggggtttcagcttttggttacagccttacaggaatctgagtctgctatagcgctctaatgcagcaaacagtgttcggtactgtacctaatttactgtacatgataatcattactgtagcgaaagtgatgtaacaactcacctttaccattagtccgttaataaacgacaaggatcaagggctaattcctggtactatagccctatgccgtagcatggtgctacatcagaggatctccttcctttgagaaggtggtatggactcgttatatgattcaggaacaccaaaaatctgatataaaatgggaaatggcaaagtaacagtatgtccgatgttaaaatgctgataaagtagagactgtgtgcaatgtgcacactacgatttcatatttcatacatgttttaatttataagattgtgatatcaaaatttaattaaaatacacatgtatgtataagcacactatgatgtatagaagctagcagcactgttatgatgcaaaaattcaaatatgtggaagaagcgcagctgagatccctttttttaagttattttattgtaaaactactaacagttacatattaatatgtccagattccagctccaaagcgaggagaaattgttaggcaaattggtgatgcattgagagcaaagctccatcacctgggcaggcttgtgtcacttgagatggggaaaattcttcctgaagggattggagaggttcaggtaggtataattgccgccagttcttccactcagagcttcattgttttttgcactcaggataggaaatgaccactatattgtgtttcttcagaatattcagtgatttatctttagaacattaatggtgtgctcatcacgaatgcttcattatcatcaataccttgcctgctagaattaccaacttagcccctaacatgatatgcagttgtgtttccttttctctctgttaatcatctttctgccaatcgaatgtcttgcctaagaatttggccattattgagataatttcatgatcgaatatttaactgcgactattgattctccaccatgaaggcatgattatgttgacataaatgtaacctctgttttgtaggaaatcattgacatgtgtgattatgctgtgggcctaagtcgccagctaaatgggtccatcataccatctgaacgtaagcccattctccctttcctaatttatatctgatgcccgcttcaaagtatgataacagcagatacttctgatcatattttctctatttggttgagatacaaatattattatatcttaattctgtctgaaaaagaatacctcaattgatttaggtttccaggttttctaatgaaattagtacttcattagaataagcaattttactccattattactaattcgctctctggattatttcatgttaagtgattctccatttcactaatttgaacacacaatatacttgccattctagtttactgttctatacaaaatcctgtcccttgacatgccataccaccattacttatcaaaatgtgccatcacacgattttctgtagtaatgataagatattcgctgattgtccgttagacagcaatattttacagagttatgcccaaattatcaccattggtttttgtggttaggatagaaggttgagccatggcgttctcaattgtagtaatgttgccatttattcatacttatgggattgtaaaattcatcaatgctctgtttgataagtatactggaagattttctaatgctgtcttctactttttttcaggcccgaatcatatgatgatggaggtaggcacaaaccagttcttttaactccagatttactttctctgtttctcatgtggaagaaagctaatccctaaagctcattcaaataggtgtggaatcctcttggagttgttggtgttatcacagcattcaattttccttgtgctgtgctgggtaagtgtcttctcttagaatatcattagtgaaatcaacttagtgcattgcaattccctgttatttacccctacatactcttgatctatcaaatgcaaaattgacaagaacttgacctattgaaaattaactgttataatccaatgagtagccgtgtccatataataggatcttcaaggtgtcaatttagccgcttactcttttgtttatgatatacatgatatgttgcatgtttatgctataatcttttgaatgctatggtgctggcgacctttatcacatgctcaaattcttgtaatccttaacagcgactaatacatcaattatttcctttttgtcatattttaggttggaatgcctgcatagctttggtatgtggaaactgtgttgtctggtaagaatgatttcctttctccataaactgaaagtactgtcctactacatgttatcagtactgtaactttctttacttatattatggatgagagtatgctcttaagttgtattctctgaacatttcaatagatcattagcttagtgttccagattataataatttcgtaatgttcattaaactggtgaaggtccattatatctattgcattttccttgcatgaactgtcttggaactgtcctttttttgtaactaatttctaaacaattgcaggaaaggtgctccaactactccgttgatcactattgcaatgactaaaatagttgccagtgtattggagaggaacaacttgccaggctcaatttttacagcattctgtggtggtgctgacattggccaagcaatttctcttgacacaaggatacccttggtttcattcacaggaagcacaaaggtatatactacagtaaactgctacctatgtcatctatgcatatttcctaatcgatccattttgatataatgacctccatcacatctccaatttctatttccttttgaggtccttttttaattctgagcagctttttcaagcatttgataattatatatcattgaactgtgctgatctactgcaaaatttgtaacactgattgctcaatgcaggttggtctaatggttcagcagcaagtgaatgcaagatttggcaaatgccttcttgaacttagtgggaacaatgccattattgtaatggatgatgcagacattcagctagctgtccgttcagtgttgtttgctgctgttggaacagcaggacaacgctgcactacatgtcgtaggctggtaagataggtttttcttatctgccccaatggctggtgtatgagtagtctaaatgcttttgttttgttaacacagcttcttcacgaaagcatataccgaacatttcttgatcaacttgttgaggtttataaacaagtccgaattggggatcctttggagaatggtacgttactggggccattgcacactcctgcttcaagagacgccttcttgaaaggcatccaaaccatcagatctcaggtgatattattgatgcaacaacatttgcttgtgcatcaatgtctgtttgcattatattaaacaatctttacatcttcaatacttaaaatgcttaagttggtagtgttgatggcctttctactcctccctataatctaaataattcttaatatgttagcagtcaaagttttcttaatttgttggcagtagtcaaagttaaagatgtttgattgcatgctttctacaaaattgtatttctgaatgtatggagtttattattccctgaattctgaatcttgaatgtacatcttaaaatgctgtgctactggaagttgttagttcagtatgtttaactagaatcaatctcattacatcacataggcacattgctgtgaatctattagagcgaaaccatttagcatttacctgtggccttgaattggttggtgattttctgtaagcagtaatttgactgacatcctaatttgcaggggggaaaaattctttatggaggatctgcaattgaatctgagggaaactttgttcagccaacaattgtggaaatttcaccctctgcaccggttgtgagagaagaactctttggtcctgttctttatgtgatgaaagttcaggtataaaagattcaattactttgcttttatgttattgatctgtaatgtttggtgtcagttgtatagtgttggaccagatcattatcatttacactacttttcgtggtcattacctgcagaatctgaaggaagcagttgaaatcaacaattctgttcctcaaggattgagcagttctatatttacaaagagaccagatattattttcaagtggattgggtaagtgtcagttcaaccacctagaaagtagcccccttgcagctaagcttgattgttataaatagaaatcaaggctcactttggcactaatggatctccatcctcctgctcatatgtagcattgtgtttcctgatgtcctaaacttgttttggtgaaggtatcagacttgtttgcttttactttaatctcattgtttccctgtttattgaatcacactgaaatattattcaagtttaacagttcaaatatacttaggcttttagaccctttttccgttatgtgcattatatgcattattagtgtattaaattcttttttaagatgatatttgatgtccatatatattgacacctaaaaagaatcataaagcgatttaacactactgaatccccgctatgtgtcatgactaaatcattgaccatattcctgtgttgtgaaatcccccatataataaaccctcttccgaggacagctgcatgcctacacctttcttttacacgctctcagatttcttttactgccatgccccataagacatgaaatgactatggtagtgatgttcttgctcttcttgctgtacaggcctcatggtagtgactgtggcattgttaatgtaaatattcccacaaatggtgctgaaattggtggagcttttggtggagaaaaagctactggtggtggacgagaagcagggagtgattcgtggaagcagtacatgaggagggccacttggtaagtagacaaattttgattcaagtatgcaagctataccttgatcaattggtaaaattcctagttccttttgcacttttcccaagttgtcgtttgcaacagcagtaactgaatatttactgaaatgtaaactgttcactcccattggtgagtggtgaccttggcttggcatgatggcttccttagagactctagtacactacaatgattagcaaagagtaaagtccatcaccggtccttaaacttgtaccgctgtatcatcccggtccctaaactcgcaaatcgaccgttcaagtcctcaaacttgttcgactgtgtcatcctagtctctaaacttgtagatcactcgtttaggtcctccaacttattcagttgtgtcaccccggtccctaaacaggacggtctaaaaactttatatcaaaaaataattcataactttttcatgtgaactctgaagacaaactttatatcaaaattgtagctctcgacgcgacctacaactttgtagttgaaaagtttttgaattaaaactgtttagggtcccaaaatattgttgcatgtttatagattttgaaattttaattttaaaattacattttgggacaaaaaatgactttaaataaaaaaaattcaactacaaagttgtagatcgcgtcgagggctacaagtttgatataaagtttgtcttcattagaattcatatgaaaaagttatgaattatttttaaatataaagtctttagaccatcctatttgacccagatgatattcaaatccaagtttagggaccggggtgacacaaccgaacaagttggaggacctaaatgagtgatctgcaagtttagggaccgggatgacatagtcgaacaagtttgaggacctgaacggtcagtttgcgagtttagggaccgggatgacacaacggtacaagtttagggaccggtgatggactttactcattagcaaacaaggggaacaaataattgttgataaattactgtaatgaagttatcatctgttggagtctgtgtaagcctgtaaaattgaagtccctaaggtggtgtttggcaaggagggactaaactttagtccctctcacaaaaaatttagtccctatgggagggacttttgcttttgtgagagggactaaagtttagttagggactaatttttttgtgagagggactaaagtttagttagggactaaggtggtgtttggatccagggacttaactttagtctctatatttagacactaatttagagtattaaatatagactacttacaaaattaattatataaatgaaagcaaatttgcgagacaaaatttttaagcctaattaatctataattagagaatgtttactgtagcatcacataggctaatcatagattaattaggctcaatagattcgtctcgcgaattagtccaagattatggatgggttttattaatagtctacgtttaatatttataattagtgcaaacattcgatgtgatagtgacttaaaagttttagtcccatctaaacagggtctaatttttttgtgagagggactaaagtttagtccctctttcccaaacaccacctaactctgtatcaaactgcacggagaataatttacataaccgggatccagccaccacagtaccttcttttttcactgtgattttgagttttgaagtttctggctattctctcattgatgttacgatgtacataaaactaatctacataaggatgctgtaacatttcggttgtgtagacaccattacgccatagaaatgttgtcagaatatcatctctgccaccgcccaccgggctattccatgtcatccattgtgatcattctgacctgggatagcacttttacccaaaaggccttgggagtaccatcatacaaatagaagcttagaatgccatgaagcaataaattcaaatagaactacacatatatattactctattattagcactgagaaaaccatttgatttgctctgccatatttttcaatgggtatttgcgacgtcccaaaactctgtgaagcatagggatcacaatatcttatgtatagatgttcccaatgaaaggcttatcctatgtacattgaattctagttccttgagatgtgaaccatgccatgaagataattactgcaagagtagcttctgttgcaagatattcagggcaataattctagtgtgtgttcaccatgctcgaaatactttgcatagataattctttatgttatagttatgcatttcctgcacactaattctcaatccaaatttctgcagtacgatcaactatggaagcgagctgcctctagcacaaggaataaattttggctagttcggtggtcaagatcggctgatgaacatgttaagcttcatcgacagacttcaggaatttctactggcgtcaactgaaaaccgaaacttcaacgcagcagcattgctatgtgtgcatataataagagatgagtccaatattaatgcatgtactgctcttgctatgattagccgtcggagttcgagtccaataaacagggaaaaattgcgtattccctgatcggttgatatgtaccaacatttctgatgtaatctttagaacggtatcggttgaaaacttgaaatgaacgaaaacgcggtaagaatacaaaatggtgtgcaaaccttcaggctaaatttcaccgtccctaataaggcaagtggctctcagaattcatactgaaaacagatcagtacaccaatgtccacttccctttgaagacaaacagattagtacaccaatgattcatgaactgatgaacagtcgaaaacagatctgcagccttgtctaaactactgtccatcactgggtattgcggctgaactgcccaacatgatctttttcattgatctataaatatatcattatctcctacaattttattcggcgtgcatacatggtagtacatcactatcaacctgtaaacaacaaacaaatttgactaaataacaccgagtatggtgcagtttatgccctaatcacaagctcatatacattgctattgttctctctgctgaggcgttttagcccctcaaaacttcttcggcttcccaaaaaatcaattcttttgaatgttacaaaacctctttctgctgattcagtacttgcgtacagcgagcgaagtcgatcagcatgtcgtgaatccgtttgcagggctacatttatctcatcggaagacatattttccttcacaaacgagaaagataattatgggttagcttacaagctaaacacaaaatctaagccactgtaaaaattggtcaagagttctgtcagaaagaggcagtattgcactcaattcaacaaacttaataacaagatactgattgtacctggtagaagttgtagatgtgatcaagcacttgtatgcgtgtgaaaccaccattgctgaagaatgtccttgaggaaggtccaagctcaccaaaacgatcaatggggaagagtacggtaaggaagtggttcttaaagatcacttcactcttctcactaaaggaacaacacaagcatatcagaacaacagttaaaaagaatttgaccaagatcaagcattgattacctttctcttagtgggcgggtgaaactatcgcttgactgatcatccttgccatccccattcgcatcgaagaaagtagtgct

SEQ ID NO: 907 - DNA, 5423 bp, Oryza sativa
accttccatccatcgatcgatcgatcgatccagcaacaaactggcatctcgcgcgcgcgcgcgagcgagcgagcgacgtcgtcgtcatatcgcatgtggcgcagacggcacgcacacgtattactgttgtttcgacgacgatccaggaagaaaaggggaaagtgatttcatcccctcgtgtgcatatataccaactaaatagtcatcaaaggatttgaaaatttttctggcaagatagattaatataaaatatatagcactctacaaacatgcaagttaaaaattcaacttgtacaagttgtaacaaaaatagcaaacatagatgcgaatgtacgttaactattttcggtttgatttgttcttttttgttgtaacctgtagaagtcaaatttggtcttgtatgtttgtatagtggtgtatttcatgttaatatatattatcatttttttcaatttttttaactatttacttcctccgttttatgttataatacattttaactttggtcaaaattaaactgctttaagtttgaccaaatttatagagaaaagtagtaatattttcaacctaggataaatttattatgaaaatatattgaattattgatttaatgaaactaatttagtattataaatattttactatatttatctatatatttagtcaaacttaaaacagtttaattttgttcaaaatcaaaacgacttataatctaaaactgaggaagtagatgacatataaacaaacgagagtacattcccacggaggaatgaaaatccatctccgaagaaaagctttagctttggtagagcgagcgagagctgcattggccacgcgagccaactaacccctccgagtccaggccggttggtacacgtgtcgccgccgccgtccgtttcccacccggagcccacgtggccgccatccgcccgtccgcccgacctaaccaccccccctcccccccgcgcctatatatatcagcacgcgccccaccacgctttgccaacccagcagcagcaagcagcgcacaagccccagcaccagcaagctgctactcatcatcagcgagagctagctagctgtgtgtgccacttacactgctgctgctgctggttctagctaagctcaccgatcgtcgtcttcgtcatcgccggtgacctggtgaattagtcgagagagatggcggcggcggtgacggtggaggaggtgaggagggcgcagagggcggaggggccggcgacggtgctggcgatcgggacggcgacgccggcgaactgcgtgtaccaggccgactacccggactactacttcaggatcaccaagagcgagcacatggtcgagctcaaggagaagttcaagaggatgtgtaagcatcccatctcacatctctctgcttcttcttcttctacctcattaatatattttgatcaatccggccatatgcatttttatatatatgcattatgcattcatgcatggatatatatatgatgatctccatgaaattttacgtgatggctgtatgcatatgtatatatgcaagctttggtttgttctctttggttaattttgttaattaattacctcatgcgtacgtatggagctacatgatggatgccggccatctagttataaaaaaaacagagagaagtgaaaaaaaaaggggattataattagctaaaagctatatgtattatatttttttctataaaggaaaaaaatcaaagcttacattctctgaagtaatatacactagctagcagttatatatgacaaaatctagcacctagctaggtgtatccatggacatggacaatcacaagctagtatatagctgcacagatgtttacaagggaacagtgtacataatactatatatgtttcttcttgtagcatgctaagagtacttttgtcttgagataattagttagggagtttgttagttatccttaagcatggtcatccatacacacacaagaacacacaagaagcatggccatggaaagaggacaacggtttgacctgatatagctaactcatacaagctagttaggttgtgtaggagtagtaggttcaggtgtctcacttactgacatgtcaagagtataagggaccccatagaggcaacttgatttctttaaaaattgaccaagcaaccagatatgaagtgctgatgttttcttcagcctgtgctttacaatttttctaatatatgattagttgaccatgcatcttcttgattaatcaaggagatcagatggaagatctactgcagcttttggagaaaaagaaagaaagcaaattaaagtaccaaattaatttgcatgcataaaagcaggcggatttggacgtttcacgggtcgtttatgggttgacggttgaagttcatagattttctaaatataaaaaaaataagcaaattgatagatcgatttttaattacccgagttcactttttcttatctttttttgcaaggagtaattaatctgaattactttgttgcgcacgaaaaccatttcttcaaccttaaaaaaaagaaaaaacttttttcccaactacaagtccatgatatcgtactatacctaccccttataaagacccagggcccacacgccatatagcaacaagacacagcagcagtggccactctcacttcgatcatgactcgactggagagctaattagttaattaccctgattaattcttccacacttaactacacatatatacaagagttacttaattaattaatttcatttttcccgcccaaaatagatactgtgagaaaaaaagaaattagggaaacgatgctgacgtcatcggaggatcaggaaatggaattgtgggagaaaaaaaagaaaataaaaagaaaaaagattaattcttccacacctaactatacatatatacaagagtttctttaattaattaatttcattttcccgccaaaacatggatactgtgagaagaaataattaattatgggaaattaaggatgctgctgacgtcatggatgcaggtgacaagtcgcagatcaggaagaggtacatgcacctgacggaggagatcctgcaggagaaccccaacatgtgcgcgtacatggcgccgtcgctggacgcgcggcaggacatcgtcgtcgtcgaggtccccaagctggggaaggcggcggcgcagaaggcgatcaaggagtgggggcagccgcgctcccgcatcacccacctcgtcttctgcaccacctccggcgtcgacatgcccggcgccgactaccagctcgccaagatgctcggcctgaggcccaacgtgaaccgcctcatgatgtaccagcaggggtgcttcgccggcggcacggtgctccgcgtcgccaaggacctcgccgagaacaaccgcggcgcgcgcgtcctcgccgtgtgctccgagatcacggcggtgacgttccgggggccctccgagtcccacctcgactccatggtcgggcaggcgctgttcggcgacggcgcggcggcggtgatcgtcggctccgaccccgacgaggccgtcgagcggccgctgttccagatggtgtcggcgagccagaccatcctcccggacagcgagggcgccatcgacggccacctgagggaggtcgggctgacgttccacctgctcaaggacgtgccggggctcatctcgaagaacatcgagcgcgcgctgggcgacgcgttcacaccgctggggatctcggactggaactccatcttctgggtggcgcaccccggaggtccggcgatcctggaccaggtggaggcgaaggttgggctggacaaggagaggatgagggcgacgcgccacgtgctgtccgagtacggcaacatgtcgagcgcctgcgtgctcttcatcctcgacgagatgcgcaagcgctccgccgaggacggccacgccaccaccggcgagggcatggactggggcgtcctcttcggcttcggccccggcctcaccgttgagaccgtcgtcctccacagcgtccccatcaccgccggcgccgccgcctgagcgctccgccctggtcgccgccggccggcctacgtacgccacacgtcatcttttatcatcgatcataaaaaaaaattatatatatatcgatatcgatatatatatatttcctaataataactactactacaataacaacgttatcgaattaaaaagttattcccttttgccgtgtgttggtagggataaaaagtgaaaaaaaaaattattactttgttttgcatgtgtcatgtatgggtggtttggttggtagtagcatatatatgtatactgaaaagagaaagggaggtcaattaagtgtcatggatggtgaggtttattgtaaacctgtgtaagagatgcttggctgttactattcaatttgaaaacttaattaattttgtgtacctaaattgatgtgcattcaagtttggttgatctttttttttaccgcaatgcatgtgtacctttgtctggcgtttcaatgctccgaccaaatgttatgtatgttctctctgatttttttttaggtaatggaaatgctctcaaatagtacattgtttctccaaataaattgttttaacttaatttgagctagcagtagcagccacgctgcaacgctttgcacttcagaactccgacaacgatgtcatgacctgtgtctactggaacggtctctctgactatgctagtcgtgtcccgaatatgtaatgattaccactaaaccgtgtttattaattttcacattatgccgatcatatgaataatttctgtttatgagaaccacgtgagtaaaaataagtactccctccttttttttattagatgatattgatgacatttaaacattcgttttatttaaaaaatacacaaatattctttattttattgttcttttttattattaaaaatatattgtatgcgatttttaattatacatgtttgtgctaatatttttaaataaaaaattatcaatttatacgatcatatgaaaagttaacggcatcatttattaaaaaaatatagtattaaaagaaccatattattatattacatatggattaactgtgggaacactcacagttaatctcacgtgacacgtatataatatatattaattaatttatttattcgagtacacaattacgatggctatactaatttatgagaggggccttcttgctccctttataatatgtcggatgtgattcctgaggactaggatagtgataccctattatttgcacgattttatttattaattaatttatttatttgcgagaaagaggttattacaatcattgagaacaagaatttatatgcaggagggaacgtggtcccgcgccataccgcataatgtgcttcgggtatcaatgaatcgaagcaccctctttataaacacgctgatctact

SEQ ID NO: 908 - DNA, 3497 bp, Oryza sativa
atagataaagtaccataaatcctgaggtaacaagtgacaagacaatagcccatcttttcagtaactttgacctacaaaatttaccaccagttacaggagtaataatacaagtagagcaacgtaggcttcatcttgaattcttgatggccggtctcaaaccaagctgggccttgtgatgggccttgctgatacaagcccaggattagcaatgaagcccatggcccagcagattctccaactcaaatcctttgcaactctgcacactgcaacctgtgttcgcttttctgaacaatcctgacattaacggcgaattgattaagatctgttcagcagccagctgcgagaaaacagtgaaacgaacgtgatgctttacctttcaacgtactgcatctctgatgccaaaagctgcctgcctacctgcatgcattagcatgagcaaaggtgaggaaaagcatatattcagttcggagcttccaatacgggaagaacacaaatactatattgacagtagcttaggtatctctaagatctccatggatggaagtggcaaggcacaattcatccgcattaacatatttaatcacacgtgttatctcaaacagagataattaattgccagcgtgtaaacttgcatatacttgtacacagcagatgtatctcatctacctttgctgataagaaaatgttcagatctcttgagatcacggtgctgctcactgaaaagcagctgaattggaaccttcttagttaaattttttgcttactaaacctccctggtgattcgattcctcgtggaggctatgatacgcaagacatcataagcatttagtcaccagcgctttggatgctttacctctttaccaatttttttttctccttttgctttttttcatcaagaaccagatgagaagcaaggcattgccagatgctggccctgatattagttttcagctttggtgttcagtatatatacccacctggacagccaaatgtctgcacacacacacactcacaactgtcaaatctcacctgcagattaatcagttaagcaacacttcgattcctcgccgccgttgccgccgccgccgaccggaaagatgccgggagccgtgaaggtgttcgggtcgccgtcgtcggccgaggtggcccgcgtgctggcttgcctgttcgagaaggacgtcgagttccagctcatccgcgtcgactcctttcgcgggtccaaacgcatgccccagtatctcaaactccaggtaattaattagagaaattttaccgttattgagaaagtattttgagatatctaaattttacactaaaattttttatacttgtatttagtatctagaggtaccaaattttacactagaaaatgttaattaactaatcatcatcatgatgaacgaaataatctctcatcatcttcatggattaacacaatcaaatgtaatggtgtagcctcacggcgaggctctcaccttcgaggacggcaatgtgacgctcgtcggtaagcaaagaattaatcaaacgtgaataaattttcatggtaagattaatatgttgatgctgagttaatgagcagagtcgaggaagatcataaggcacattgcggacaagtacaagaaccaggggaacccggacctgatcgggatgggggcgttggagaggtcgtcgatcgagcagtggctgcagacggaggcgcagagcttcgacgtgcccagcgccgacgtggtctacagcctcgcctacctgccggcggcgacgacgcagcctaacaagggcgccgccgccgccgacggtggccgctgcgaggaggagaagaacgacgacggcggccgtgaccggcagtacagcagccagaggcagggcggcgccggcgccggaggaggaagggatggccagatggcggcggcgcaccggcagaaggtggaggagatgaagcagctgttcgagaagagcagcaaggagctgagcaaggtgctggacatctacgagcagcggctggaggaggcggagtacctcgccggcgacaagttcaccctcgccgacctttcgcacctccccaacgccgaccgcctcgccgccgacccgcgcacgctccggatgctgcagtcccgccgcaacgtcagccggtggtgggccgacgtctccggccgcgagtcgtggaagcaggtcaagagcctcaaccgcccgccctccgccgaggctcccttctgatgatgaggtcagccaccgtgctcttccggccgccggcggcggcggcggcggccggcgagaggaggaggaggaggagaagggggtcgctttgctttatgattcgtgctgcgtacacattttccaatgtcgtcgtcgtcgtcgtcaataaccggacacgtacgttcgtgttcgcgccatatatatcctgctgctgttggtgaattccgagtggtcacattattatattatataactgtcagtcttgtaacaagttcaataaaatgcttgcccctttgtcgtgatatttatacgtgattcctcatcaaattccttcgttttgagatgatttgtcgtgcagttttcaagctcctccccgatttctttctttcattttgatatttgaacactggtctgtaaatttgtgtgtgtattcagtttagagggcaaaacttgcgttgggcctcacattatggagggaggcccagattagagtgggctgcacgtcatttggctgctgcgatatgggccgtgggccgtgtattttgggccatggttcgctctcccctagactcgccggcggattctaccaccccttccgccgccgccggcgtgttgcactccgtctccggcgaggttcccccaagccccaagactaggtgatgaggtaatcatgcagcagtaaaatagcatggctgtgagccacttaaccatgatcctatcggaattcgggatcgtaataaaactttggtttatctttctgtagccgtcgtatccggtatgatttcttcttttaaccgtttcgatcctgaaacagatatgatctgctttttaatataactctgaaactatcatgtttttctcagatagagggaaagaggatcaagtttgttgaatctgaaatttcctaaatatcatctgaaggttcacatgttgaatttctgatcagtttcattccatgaatttctgtttaaatcaacgaattgggtcatagtgtttacgggtagtagctttcagaatcgtagccagagcgtaagcgtggcaaatttttgttaccgataactgtaaaatttgcattttccccacgatgctgatcatgtcccagtaaattttagagtgttttctgcatgctgtatgtttcagcattgcaagtaataaatcctgcagaagttgtttaactgtttcatattgggggcatggttactactatcagtttagacaatttcattattctgttgattttcagcttaatttagatatagcttaatcaagcttctgaaggattgtttaaagcatttctagttcct

SEQ ID NO: 909 - DNA, 2989 bp, Oryza sativa; identical to SEQ ID NO: 796

SEQ ID NO: 910 - DNA, 3854 bp, Oryza sativa
tcgaaccatcatcaatcacttcacttgccatgcaaatcgcatgctctcctgcaatcccgcaagtgtacggttaataattcggatcggatcggtacggatgcctatctaacgccaattgcgtgccacgtgtcagtcaaatgaccaataattattaatttgtgagtacagttccctccattttaaaatataagtatcttgaagctatatacggatattaaaagctaggtacaaattgatgtttggttgataaaagaaagtaagtgaaaaattaaatgtaaaatggttgtagttagttgagacgagcggtagagaacttgagtggtacaaacatatttattttgatttatttgtttgaaaaagaaggcaaaagaattatcttttatattgatagagttaggagatcctcaaatatgtacatcatttgagagttagagtcggccctaacaaaagagggaaaagagttaatctcctttcacaactcccaggagactaggataatcatcgacttgagtactttctttggcatgttttgcacggaggtggttttcacccaccactgctacattgttgtacagttcgtcaactctattggtttgttatgtagctgcgatcatgtgcttatggcgtcctagatcctcttagagaggcggtaatgagcgagtaatagacttggttttgtcaatttctggttttacagtctactatccagactgttttggatgattattttggaaaatgctatagacatggcaaaattaatttattttgtgacggaaaagagtaaaactgagcagacggctgtgcatgcatttcggagctccagtaagctctccaccctggcttgtccattttttggccccacgtaattaagccaaaactagctagattgtctctgcacctcaagctagctagcaccactttaattaatcaggttaattgtatgtgtttttttttagccataggtcgtgtatataagggcggccatggccaatctgaatccgtgctctgcctctccattattccgactctcgtaagattaaggggggaggaattggagggcagaggccgccattttaatcagtggaaataaaatccacgcattttatatatttaatttaacccccaattttaacttagcagcacactagctagctagctgctaagttaactatttgatcaggttacagttgctggcctgacagttaattaatctcttgctggttgattagttgctatcagctacacgctctcgctagctgccactgtactaatacatactcccatctattcgcctgagaaaatatcgaaaagtagcagcaaagaggagcaggcaagatggtgatgaaccctgacgccgtccgcaatgtcgttggaatcatcggtacgtcgtctcgaattgaacctgcttgtagatgcttcatatatatatatatatatatatatatatatatatatatatatatatatatatatatatatatatatatatatatatatatatatatatatatattgatcgaacattagtaattgactaataattgattaattgtactaggtaacttgatatcgttcgggttgttcttgtcgccattgccgacgttcgtgacgatcgtgaagaagaaggacgtggaggagttcgtgccggatccgtacctggcgacgttcctcaactgcgcgctgtgggtgttctacggcctacccttcatccaccccaacagcatcctcgtcgtcaccatcaacggcaccggactcctcatcgagatcgcctacctcgccatctacttcgcctacgcccccaagcccaagcggtgcaggatgctcggcgtcctcaccgtggagctcgtcttcctcgccgccgtcgccgccggcgtgctcctcggcgcccacacctacgacaagcgctcgctcatcgttggcaccctctgcgtcttcttcggcaccctcatgtacgccgcgccgctcaccatcatggtatgtgtatatatatctgtcgattattaattttttgcatgaatctgatctgatgattaattatttgatttatatgtgtgtggcaaaatgatgtaattactacatggaatgaatgtagaaacaagtgatcgcgacaaagagcgtggagtacatgcccttcacgttgtcgctggtgagcttcatcaacggcatatgctggacaatatacgcgttcatccgctttgacatcctcatcacggtatacatattatgcatgcatatatatatatatgctttcaattatctcataaataattactaggatcagtaagtagtatagttgttattataatcatagagtaattctagctaatagtactatatattaatgtatcataattaataaataaatagataccgaacggcatggggacgctgctgggcgcggcgcagttgatcctctacttctgctactacgacgggtcgacggccaagaacaagggcgccctcgagctgcccaaggacggcgactcctccgctgtgtagctacatatgctatatatcttgccatgcaaagaaccacaagatcgaagctaacacaaaccatgcagcatatatgcacatcacacatgcagtatcacaacgtacgcatgcttggatctgcacgcaccacgcgcgcgtgcatgtaactgtgacgggttataatcgatctgttggatggatatggatcatggatgcaggcaatgcagctgctcttctgtttggacccactgaattcgcccgtgcatgcaggcagcttctttgtgtgtgtacatatccaactatgcaagaggcaggtatatgtgagcaaaaggcccccaaatgcaatgagatcgatacacatgtttgactgttcgtcttattcaaaaacttatataaaatatgtaaaactatatacatacatataagtatatttaacgatgaaccaaatgataagaaaaaaaaataataattacttaaattttttaataagacgaacgatcaaacatatttaaaaaaatcaactacgttaaatatttagaaatggatcgagggagtaggttgttaagctttggatgagctggggcggcctcgctcttgtaatgcatgagggaggctaattaaactgaagggtacggtgcatgcacatgtataaagcaactaatgcagaatatatcatcggtgacaaaaatactaattgaaggcaattaaacgcatgaagctagagctagatgcatggcatggtgatacattcagagtacgccatcgtcacaagtggaggtggaggtgatgtagcttgcctcggaggtggcggcgccgaggctatcggaggagcagcaggaggagagggaggaggcggatcgcggggcggccatgcggcggccgaagctgtcgtagtggacggcgccgtcgaagtccagtggctggcaccgctcccccatcaggatcgtccgctgccagatggcctcgccgccgccgccgtcctgcttggccggcgcggacctcccgccaccgtagcagcggcggtcgaggaggaggaggcggcggctgacgcgcgagaggccgcggccgcacaaggcgacgaggctgctcagcctgcccacgacgtcgtggtggtggtggtggtgccggtggtcactagtgtaggcgacggccatggatggaatttactactattagctgcagctgcagtggtgattcacgaggagatgaagattagcgcgcgcatgccgccgcgcccgcgcgacgaaaggttccaccgatttagttggagttggagttggaggaacaagtcaaaaggccgcggcccactcgcgcgcgcaccgcaaaggcccaacttacaaaagcccaattcactacggcctactcgcccgcaggccgca

SEQ ID NO: 911 - DNA, 3530 bp, Oryza sativa; identical to SEQ ID NO: 566

SEQ ID NO: 912 - DNA, 4484 bp, Oryza sativa; identical to SEQ ID NO: 371

SEQ ID NO: 913 - DNA, 4329 bp, Oryza sativa; identical to SEQ ID NO: 265

SEQ ID NO: 914 - DNA, 3122 bp, Oryza sativa; identical to SEQ ID NO: 211

SEQ ID NO: 915 - DNA, 4095 bp, Oryza sativa; identical to SEQ ID NO: 418

SEQ ID NO: 916 - DNA, 4423 bp, Oryza sativa; identical to SEQ ID NO: 592

SEQ ID NO: 917 - DNA, 8386 bp, Oryza sativa; identical to SEQ ID NO: 666

SEQ ID NO: 918 - DNA, 7461 bp, Oryza sativa
tctaataactctgtatgttcgaacctcctttctcttggtcatggctctcccattatatctatctagggacaccacatgatcagaatattagggagatgctaattaagtgcatagtgccggattatgtaaggaaaatcttgtcagcactgctcctctctccctttttgcgaggcttagcgtagaaccacgaaaaaaaaacttgtattaaagacaccaagataactagctgcaaacatcccagacaagccgatcatactcgaaatcaaccaccttctctatcacatcatattgaatttaaggtttatccaatcacattcaaagttactaactacagcaaccaggaaaatcctcgaaagaattagaagcatcaatgaagaagcattgaacatcacttctataatccctccaggaaaccatcagaagtaaaacattctctggcccccattggttgaatttttttctaataagccaaaacggcttattagagaataaaaataaatgtgtaggtaaaacttttatatatgtgttttttttaacttaaaagccaatactgaaaaaaactacgttgaaaatatctcagaatcaatctcaaaattaagtttgaaaattcaaaatttggcttattctttggcttattgggccatctgatgggagcctctatatttggtagcacataactaaataaataaaagggttcatattcctaattgtcgaaagtctctcaaagtgacataacacactagtatttacactacggacaaccctcctagtttagactttagagttacatgttgcccagtttcgaggtaaagtagactagctcaaatgtgtctcaaacagtcgttcccggaacataagtcacaagtgttcccacgtgtaggcatgtttcacgcttagatcgatcgagtttcgtttccatctgtacgtacgttgtaccaccccaacccgtcgatcgatatgatcgatcgtcccctataaattggacatcctggacatgctctttcttcagacatctccacccttcctatcttgatatataacttcgacacactgacaacttaatttgtcagaatgctcacggccacgcagactctggcgccggcagtgctctcccggagccatggcgccccttcttccttctccagccagccgcgccgcaccgccgccgccgcctcgagagtaagctgcacccgcgtcggcgccttgtcggaggtcgtcaatggcgaactcgtcgtcggcgaccaagaacagacgaccgacgacctccttacgcggcacaagaatgtcgtcgccgactacacgctgagcgccacggtgacggtgagcttgaagcaggacgattccactccccagaaggtggcggacatggttaatcgagactggcttttccttgatttcttcagctcgcatataggtgatgacaagctccatagctactctatcgatcgtaccggccgcctctttcgcgccatatataatcttgaacatgggcactgattcccattcgaaaaaatatcttaatttgagaggatgctttctactggtagctagcattctactactagaattatcgtattaaaagtgatcgcagccgttcgatttactagctagctcgaatgatagcatatattgtaagtgtaaattttgatacattttgatatataacttcgacattaggaaaaaaactacattaaaaattttggtacctaaaaaactataaaatttctactattatcagtaaaaatattttttgcttaccattagtagattagattgtatataagatatactacctctgttttttaatagatgacgccgttgactttttctcacatgtttgaccattcgtcttattaaaaaattatataattataatttagtttgttatgaattgttttatcactcatagtactttaagtgtgatttatatcttatacatttacataaaatttttgaataagacgaatggtcaaacatgggagaaaaagtcaacggcgtcatctattaaaaaacggagagagtatatgattcatcggaattaaaaaatagacggtataacacattgtaaaacacctattttcgtcactctacagaggggatgcacacggagcctcagctcgccaggtactcgcacatggatggcaaaggctccttcatatacgaggccagcttcagcatcccgtcctcgttggacgccgtcggcgccgtgcaggtcgtgaaccgctacagcagcgaggtgtacatctcggacatcgacgtccacctctgcggcggccgccatcagtggaccgacatcactttccactgcaactcttggatcgactacaaccccaacgaccagcgcttcttcttccctctcaaggtcaggggttcacgttattgccgataccgatattgttttattcgtgaggatggtaaaattagctatcggccaaaaattccttttttttttgaattagctcatatgtaaaataaaattaaaacctgcaaaccatcgaaaagggtggaggattatatttgcttaattagggcagtcccaacccataacactagacatggtttatataacactagacatcatcaagaaactagtactacacactactcttccaatgcaaataccactattccatacttcagttaaatgctacttatctcacatgatgtcttagatgttgtgtagaaaccatgtctcatgcaagacatggtttccttctctttctttatttattcacttgtcacattatatttttgtcctaggtggcaacttatttaatgctatggacaccattctagttattgggttgggaatgcccttaagggtgtgtttgattgggtggctgaagctgcatgggagttggggataaggcagccatctctcactagattggatgagtggatgaggagaacaccatgtgggtgatgttgctgattggctgtgataggtttaacttgatgttaacaatctcaaactgatttttttttctaaactgattatcctatttataatccgattatatgattatatttatattatagttaatcttcaaaacaaaatttcacatggttatacgaatgggtgccactgacttattgcgtccatgctatatcctccagcctatggatatatcaaacaaaacatagatgggttatcccatccccatccacttatgaccgtgaactaaacgcgccctaatctccatttccgctcgatcgatcgttgttcagctgcaaatcattcacactgcttgttatttgcttgcatgcacgatattgcagtcgtacctcccgtctcagacgcccaggggcgtgaagaatctgcgcaaggaagagctcagggccatccgcggcgatggccgcggcgagcgcaaggagtgggagcgcatctacgactacgacgtctacaacgacctcggcgaccccgacaatgacccggccactcgtcggccggtgctcggcggccgcgggcgcccctacccgcgccgctgccgcacgggccgccgccgctgcaggacagacccgtcgtcggagtcgccgccggccaaggacggcgccgggatctacgtgccacgggacgaggcgttcacggagcggaaggccggcgcgttcgccaccaagaaggcgctgtcggcgctgtcggcgttcaccacggcgcagagggtgtccggcgaccggcggcggggcttcccgtcgctggcggccatcgacgcgctgtacgaggacgggtacaagaaccggccgtcgtcgtcgcagcaggaggcggacaacctcgaaggctacttcagggaggtgctccagaagcaggtgaagctgctgctcaagggcgagaaggaggagttcaaggaggagctacgcaaagtgttcaaattccaaacgcccgagattcacgacagtaaattactactactatatattattctacgttatagcaaatactctccgttctaagatataagaatctagaattggatagaacatttttagtactataaatttggacaggctgcctgtctagatttatagctctagatatccaatccgatcctaggttttatattttaggacagatgagtatataccagcttaataattatgagctcaaattaatcgcagaggacaagcttgcatggttcagagacgaggagttcgcgcggcaaacgctggcagggatgaaccctctcagcatccaacttgtcagggacacggcacgttcctcatcctgtcgatcgttaattcattgactaattgtctttttttaatccaaatcgattagtaatattcaatttcctcatcaaataattgctcaacaccaacatgaaacgtatgtacgtgcaggacttccctatattcagcaagctggacgaggaaacctacggcccaggggactccctcatcaccaaagagctgattgaagagcagattaatggggtcatgacagcagaggaggtgaattaaaaggcacataaaaaaagagaatatatatatatatatacacacatatatatatttaacttgcttttaaaagatagagaatacactgtacaggccgtggagaagaagaagctgttcatgctggactaccacgacgtgctcctgccgttcgtgcacgcggtgcgcgagctggacgacaccacgctgtacgcctcgcggacgctcttcttcctgacggaggacggcacgctgaggccgatcgccatcgagctgacgaggcccaagtcccccaacacgccgcagtggcgccaggtcttcacgccgggctccagcgtcgcggcgtcctggctgtggcagctcgccaaaacgcacgtcctcgcccacgacaccggctaccaccagctcgtcagccactggtaatttacgagaaattttaccgtccttgagagatactaagacgtataaaaaataaactgcacgttttccgtatcttctagtaccaatggtaacgggagataccatattttactttaaaaacaaactgtatacctccttaaatactgtaaaatcactcttagtagttgactattaatttcatcatctgttgattgcacttgcattgctgcgaatcatgtttgggtgttcaggctgaggacgcactgctgcgtggagccgtacgtgatcgcggcgaaccggcggctgagccagatgcaccccatctaccgactgctgcacccgcacttccgcttcaccatggagatcaacgcccaagcgcgcgggatgctcatcaacgccaatggaatcatcgagagcgccttcgcgccggggaagctctgcatggagctcagctcggcggtttacgacaagttttggaggttcgacatggaggctctgcccgccgatctcatccggaggtaataaccaacagctgatcgatgtaatttgttccttcctatataaatataggattgatgtatataagatggttttttgttggacattgataaaggggcatggcgatcgaatgcgaggatggcaagctggagctgacgatagaggactacccgtacgccaacgacggcctgctcatctgggactccatcaaggagtgggtgtcggattatgtgaaccattactaccagttggcttcagacatccacatggacaaggagctccagggttggtggaacgaggtgcgaaccaagggccacccggacaaggaggaagggtggccagagctgaactgccacgggagcctcgtcgaggttctgaccaccatcatctgggtcgcgtcggggcaccatgcggcggtgaactttggccagtacccctacgccggctacttccccaatcgccccaccatcgcccggcggaacatgccgacggaggggcaggcgtgcagtcacgacggcatgcagccaacgttcgttgaggatcccgtcagggtgctactagacacgttcccatcgcagtaccagaccaccctcgtcctgccggtgctcaacctgctatcgtcacactcgcccggcgaggagtacatgggcacgcatgcggagtcagcgtggatggcggacagggaggtcagggcggcgttcgggaggttcaacgagaggatgatgagcatcgcggagatgatcgactgccggaacaaggatccggagcgaaagaaccggcagggccccggcgtggtgccgtacgtgctgctcaagccgtcctacggtgaccctaaggacatgacgtccgtgatggagatgggtatccccaacagcatctcaatttgagttgtgccaatgagcttgcatctgtttggcgtgctcatcgtgacattatgtatgaaataaaatggattaaaaatccggcctcgtcaaggaatggctaacacagcgagcctgcatctgtttggagtgctcatcgtgcgattatgaaataaaatgacctggcatctgtttgccactgttttcttgtaactactgcactgtagtaagtacaggacaccgtatatacataacgccctgcattatttccttgtcggtatagatggctatcgatcacagtgtagcgtgctagtactacagaaaggtcattcctattatacaacccctatgctacgtatgtagcacagaggggttgcatgatgtttacaataaagtagagacaagatatgaaggtgtggcatcttttcattcattctcttctcattcaccaatacaattctcctctctactcctctatttatagtcgtttcattttccatcttccatgtttagtaataggcccaattaatgtgggtaaccaggccgggctttcatgggccagcagtttccaaacactcccccttgagctctcattgcgtgatgcctatgcctcatcaaaactccaaaaaactcagtggaaaaaatttggagaaagagtaagcatatgctatgcgtgtgaattgtctcattaaaaaccttgataaaaaattgatgcgaaaacttatccaagggaaaaagagtacaatccacccaattcttcattcaatctttctagaatgattttttggtacttgattttctatatcaagattctggaatgagtcagcctaattctcttcctgaattttgcatttatctaagtctcattattccgaattctcggacacatctattcaagagaagatgttaatattgagtttatggacaaatcagcaagactttcacataacttagtttgttgcttctatgcaattcatgtacatagaagagcttagggtttatgtgcttagtgagtttgcttctcacctaactcatttgcatatgtctgatatatgctgtttcaatttcataaatggtgggggttgagatagttttcaaatcgtgattgctgtcgcagtttactatctctcaaaaccatgctggacctttggatagttcaatgatgattcattcggtttagtgcaattttcaccaagtatttgagcgctgctatcacacacttgtgtttgggaatactgtcccaactttagtgataatcgactattccaaagccatg

SEQ ID NO: 919 - DNA, 6074 bp, Oryza sativa; identical to SEQ ID NO: 597

SEQ ID NO: 920 - DNA, 4984 bp, Oryza sativa
tgctaaagtaatatgtgttttctttacatctaccgtaggttaagtatttactaggagaaaacagcagaagagtcaaacagctagcaatttaattccacacctagtcatcaacatgttcttttcttaattttactgaaatggacaaaaaagagtgtgtcatgcacacgcagtcatacatcttagtacatttgcaaaaccagaggcaagtatatgaactaaacgttaatagcaatggctatatataattaatgtttactcagatttgcttgttaacaccccagatcattagtctctgaaaaaaaatgtcatccaacaggcggcccaactgactgcaattctggaatattttgagcacattttcttgcctcaggtaattaaatctaataaatgatcacttgttgactaggatatgtcacaatcaggtatggaattgttgttaattttgtgtccttttctgtagcgttgcttatgaatgttaagatgacttaaagtgacatgaaagcttaaaaaaagtcagtgcaattaaattttagtaccatattattctatctccttgctttttcaaagaaaaattatttgtgcagtatatatggcaccttcaattaatacaaggactttgatgtatctggtctacaaataattaattaatgttcagtcatatatacctattaatacaagaccacaaaattaaattaatgtgatcatcgatcatattcagtgcattattgcacatatttactacattaactacacgtacatatactgccaaatccacatctagctaaatattaattgtgtacacctaaaaatatgtacatgtaacgtaaaaatacgtggtatatataccagtattctacggcaatcaacacgtatacatattactttttttttctctggtcaacagtagaaatagaaactgaagatcacctatacgtcaaagaatcccattgtgatttaatgctttaattttggcaacaatctcctggatataaatgtacacgcataattagatagatcatctatctatatatataggtgtgcaagttcaagtgcaagagcacaacacccttattaatccctaattaccaaacactctcatcgatcgatctcgcggattaattaaagtggtattagcgagcttaaacgcgccgctaatggcggcgatttacctgctgatcgccgcgctgatcgcctcctcccatgcactcgccgcgcatggcgccggcggcggcgttccgttggcggcggcggcgcctctcccgttccccggcgacctcgccgcgtccggcaagctccggaccgacccgaacgccaccgtgccggcgtcgatggacttcggcaacatcacggcggcgctgccggcggccgtgctgttcccgggctcccccggcgacgtggcggagctcctgcgcgccgcctacgccgccccggggcggccgttcaccgtctcgttccgcggccgcggccactccaccatgggccaggccctcgccgccggcggcgtcgtcgtccacatgcagtccatgggcggcggcggcgcgccgcggatcaacgtgtcggcggacggcgcgtacgtggacgccggcggcgagcagctgtgggtcgacgtgctccgcgccgcgctggcgcgcggcgtggcgccgcggtcgtggacggactacctccacctcaccgtcggcggcaccctctccaacgccggcgtcagcgggcagacttaccggcacgggccacagatctccaacgtgctcgagctcgacgtcatcaccggtaatcacagcaagcaaccgcctgcctctagctagctaattacgtacacctcactgcaactccttttgctagctaattaatcctcacacatacaaacctcgtgatcaagaactaaccgtgcaatcaacatttataaaatttaaatatactatactacatcagagtgaaatgtgatattcctatagaattattctacgtgttttctattcggtatttaagtaggatgctgtgatcaaaagggatacatgcatttgtctcataacctcgagttttatgtttatctaatttattacctacacatctattaatagaggtaggagatgtaaattattttcattatttttaaaaaatctgttcaaaaataatgtgtccacatgcataattagaattttttttacatattgttaactaactaattttaatcttgttacccacatacatattttttcctcccagggccttccggctagctccacaagatggtgggctagacgattttggtttgaagccttgccccttctaataatttgatattaggtcattccctaatattcgtgtttttaatacggtgttcttaaatgataattaaaggttacttataattagtgggtacaagttagtgtccagcactcaatgctagctgcgccggccatggctggctggttggccggcgacgtctttgataagtacatttggcggctcgcaacaaggggggttgactttgaaataatttccgcgattaattgaaagtttacatggacgacgttgactcggggcgcatgcagggcatggcgagacggtgacgtgctccaaggcggtcaactcggacctgttcgacgccgtcctgggcgggctgggccagttcggcgtgatcacgcgcgcgcgcgtcgccgtcgagccggcgccggcgcgggcgcggtgggtgcgcctcgtgtacgccgacttcgccgccttctccgccgaccaggagcgcctcgtcgcggcgcggcccgacgggtcgcacgggccatggagctacgtggagggcgcggtgtaccttgccggccgcggcctcgccgtggcgctcaagagctccggcgggttcttctccgacgccgacgccgcgcgcgtcgtcgcgctcgccgcggcgaggaacgccaccgccgtgtacagcatcgaggcgacgctcaactacgccgcgaacgcgacgccgtcgtccgtggacgcggcggtggcggcggcgctcggcgatctccacttcgaggaggggttctccttctcccgcgacgtcacctacgaggagttcctcgaccgggtgtacggcgaggaggaggccctcgagaaggccgggctatggcgcgtcccgcacccgtggctcaacctgttcgtcccgggctcccgcatcgccgacttcgaccgcggcgtcttcaagggcatcctccagacggccaccgacatcgccggacctctcatcatctaccccgtcaacaaatccaagtaaacacaacacattgacattatcgccgacattgtcacttttctcgaagatcatcatcgtcacgatgcactgtacaatatgtgggtgggtgtaggtgggatgcggcgatgtcggcggtgacgccggagggggaggaggaggtgttctacgtggtgtcgctgctgttctcggcggtggcgaacgacgtggcggcgctggaggcgcagaacaggaggatactgaggttctgcgacctcgccgggatcgggtacaaggcgtacctggcgcactacgacagccgcggcgactgggtgaggcattttggcgccaaatgggatcgcttcgtgcagaggaaggacaagtacgaccccaagaagctgctctcccctggccaggacatcttcaactgattgattaattaattaattaattgttgcctaattaattaattaattaattaattagttacagcggttaactttagtcaaaaaatgaaataaacataatgttgtcgagaacttactgttgataagtagttactgtgacttgaaaacaaaagtgtgtagctcctcctcgcatcttgtatgatggaaggatgagatgggggttacaagcaataaaaaagaagatgatgaaactagtaatacaacttaacgcatgttcctttgtttgtaaaaatgtacaactgccacttatagtagacgtatcgctgtaacatgttaatgtactttttcccgcacttcgggtctccttttccctaattcatagtacaaagactaaattgattggtgattaaaaaaatattacattttagaaacaacacacttgatagtggtaaatttgtgggtgcattattgcggtagaatactttttaaaatataatgagaaatccatcctttactttaaagagctaataaattattacaaagtatgtagttttaaagtattcactctgttttttaatgtgtgacgtcgttgattttttaaatacattatatttgactattcgtcttattcaaaaaatgtaattattatttattttattgtgacttaatttattatcaaatatttttatatttgcaaaaaaaataaataagatgaatggtcaattaaaaatcaacggtgttatatattaaaaaatagatatgagaaaataaaaccagacaccaatagatagagacacattgtttcgccacatatcctattgttaaactttaatcatagtcgataaaaatttgcatgaccgttgttttcaaactcatgacatgcatgttgcatcctatctttgtgttcaaacctttgcacggggcttattgtcaaatccaataagtggccacgtatttagtgaggatcacatatttaatgagagcagcgcatatgtttcttataagcaggactgtgcatgttagaaaaaacaattctacatttttatgtttgaaactttcaccttccaaacaaagacctttgtttcacacgggttgaaaaatgcatctctatctatgatgagcatggacgagattcttgtagatgttactgggaatctcattaaactacatggctgttacgtaactaaatcggcaatgatcatttgcaagtcggctgctaaccataatagttgaccccaaggggaagcataagtggtgtggcggcgctggagtcgtggatatatgactccatacaccagggtttaaatcttaatgtccgcaaatattacgcacatgcaagtagctttcaacgctgactttgaaattaacgatgtat

SEQ ID NO: 921 - DNA, 4007 bp, Oryza sativa
ttttttagtactccatctgtatttttttaatgtatgacgccgttgattttttaatcaacgtttgaccattcgtcttattcataaaatacttatgtcatgattaaagaacatttgatgataaatcaagtcacaataaaataaatgataatgacataaattttttaaataagacgaggtcaaacgtttattaaaaagtcaacggcgtcgtacattaaaatacggagtattactaacatgatcaaataatcactcgattcaatgagttaccgtagaaaggtacccgaaaaaaaggaaaaagggaaaccgataatgcaaaatcacaaagtgcgatatcgcgaaacaaagaacgatcaacgggacagtgatccacgtacgggaaaaccacccatctccggcgacagtgatccacgtatgggaaaaccacccatctccggtgaaccatcggccaatccgcggccccgctggcccacacgcatgcgtccaaacagcccacccccccccccctccccctcctctcccagtcgctacccaaggtttctagaacctacaggaatatgtccaatccctgacggaccccaaacctaccacagtctagagagcctcacgtactagcgttacccaaaacaaatccgtagggcacccctaccccccaccgcgcgacgtgtcctacccccgctgccctctcgctccacctcgccccccgcatgcctgccaccctcctcccctcaccggcacgtgtccccacctcctgcttgacgcccccgtctcgctggaagtgggcccgactacgcgtggggcccgtgctgtcagtgagacgtggcgctgcgcccaccgggatgtggggagcgagagacggcgtcagttaccggatgcgtggtactactacgacccctccgcccacggcggaaccgtggttggggtttaacgcaaccatggttcgactctatcccgaggtgggagaccgtggttagtggagcagtttataagcgcgcaccgcttcggcttcgtcctcctcgccttacacatcgcaccactctctcttactcgtccatacgccgagtccacgagatctcgccgtagtccatacaccggttgatcggaggtcgtgttgccgccggcggtggccatgatgatgatgggggaaggagtcagcagcgtcccgccgtggtctcacctccccgtgagcggagtcgatgtactcggcggcggtggtggcggtggggatgagatgacgccgtacgtgatcgccgcgctgcgggattacctgccggcgaatgatgtcggggtgggggctgacgaggaggaggaggccgcggcgatggccgcggcggtggacgcgtacgcgtgcgacgagttccggatgtacgagttcaaggtgcggcggtgcgcgcgcgggcggagccatgactggaccgagtgccccttcgcgcacccgggggagaaggcgcgccgccgcgatccgcgcaagtaccactactccggcaccgcgtgcccggacttccgcaagggcgggtgcaagcgcggcgacgcctgcgagtacgcccacggcgtgtttgagtgttggctccacccggcgcgctaccgcacccagccgtgcaaggacggcaccgcctgccgccgccgcgtctgcttcttcgcccacaccccggaccagctccgcgtcctcccggcgcagcagtccagccccaggagcgtggcgtcctcgccgctggccgagtcctacgacggctcgccgctgcgccgccaggcgttcgagagctacctcaccaagaccatcatgtcctcgtccccgaccagcaccctcatgtctccgcccaagtcgcccccgtcggagtccccgccattgtcgcccgacggtgccgcggccatccgtcgcggatcttggcccggcgtcggctcgccggtgaacgacgtcctggcctcgttccgccagctccgcctcaacaaggtgaagtcgtcgccgtccggcgggtggagctacccttcgtcgtccgccgtctacgggtctcccaaggccgccaccggcctctacagcctccccaccactccactggcttccacggcaacggtgaccaccgcctccagcttcatgcccaacctggagccactggacctcgggctcatcggcgacgaggagccggtccagagggtggagtccggaagagccctccgggagaaggtgttcgagcgactgagccgggatggtgccatctccggcgacgccacagccttcgccaccgccggtgttggcctcgacgttgattgggtgtccgacctcatcaactgaggcttccaagtcgctattggaagccccttttgtgagcatcaaggatgatggcatggaggaggagaaggtggcggtaagaagaaaatgatggcacgacaaaaaaatccttcattttcttttgtgatttcaagtcaagtttctactaattcctgtacatatctatctcccatgtgaatattcatggttggtggagaggaggcaagtatggaaagatgggtggatttgttttggggttttgaggtagtagcaaaattacccacaaaaaaattaggtgaaaaaaaaaagaggagtagaaatggaggtgattcagtgtctcctgtgtgcatagggtgtgtggaggtgaaggaagcacggaaggaagaagatcatggcggaagaagatggccggatttcggccgccgtcgcggcggcggccctgcctatttcagtgatttctgggggtttatcctctgttcatcgtttgttgcatcatcgactagctgatgaagatcgtcgatcgatttcaatcaagccccccctcttgttgatttcctattttgttgatgtaatctttgttttgttaagaacccccaacagcatattttgtaccttagctttaaatctgaaaatcttttgctgactcatctacctatatgtggtgatgaagcccccctcaatgtattgtaatcacctgcttcaagtaaatgatccaataatattatgttgctatatgtttcattacttccttgatccaaataacactcatcttaatatctctgttcattagtgacgaaatcgatgtgttttgtggagctgagcggggggcgatggtgccggggaacctgccgtgacagagaccggcggagagtgcgacggcggcggagtcgccggcgagtcgttgtcatctttggtggaatcgatggtgcaggattggcctgcacatgctgcagctctctgcttcttccaccgcaccgctgcttggccacaaaaagacacgtcctctttattcgagtatgtacatgtactactacccggtagcgtagcgtccgctttgccttttgcaggcagtgcgactgttcatcgcccgtacacgtcgccggagttggggaagacgacgatgacgccggcggcggcggcacccgaatctgacccggatcgatcggatcgcggcgactccgtctcgagacgaatgggttggtgggttgggtcgcgaacgcatcggtcggagtcggggtcggggtgggggagaaaatatcgggtgcttgtgtgtccggttcccacgagacagcgggcgtggtggtggtggcttcttgttgctccgtttcgtctcgtacactttcactttactttctttttttgatgggcatgtctagtccttttcgacccttcctgtttacgtcacgacctcgcacagtccagcaagctccatacacagtatcccgtagaaaaaaagatggcgtggactacagtatatatactgtaccgaatacttagagcaagtttaataatatagtcaactactagctctaaattcatctataaccaatctaatagctcattcatacaatagttatatactacactattaataactggtctcacatgtcatacacacactgtgtcttagagtccgtactacagctagccagctgttcttctctctgttaatcttcttaaaatatgtttatagctgacttatagtctgctattgtacctgctcttagagcaagttttatagcca

SEQ ID NO: 922 - DNA, 6603 bp, Oryza sativa
aagtttgtgtgtgtagaaaagttttgatgtgatggaaaagctaaaagtttgaagaaaaagtttggaactgaactcggccctacttcctccgtcctaaaaaaatccaaaactgggtttgaatctggacatgcactgtgtccagatttaaacccaggattgatttttttcagatggagggagtatatatattgtgaatattacaataattaaaaccaatatatatatgggtcctacctatacgtattactcactccgtctcataatataaaggattttaagtttttgcttacactgtttgaccactcgtcttattcaaaaaattttggatttattatttatttttttacttactttattatccaaagtactttaagcacaacttttcgttttttatatttgcacaaattttttaaataagacgagtggtcaaataataaaaaaaaacttacaattgagacggagggagtacttttgctatatatatatatatatatatatatatatatatatatatatatatatattgtgagagggagggagagagggaacagaggaaggcaccaaagaaagaggtgggggtagagccgcagagagagcctctcttaactgcagccataaattatccacccttgccacattgagaatttcggaacacggtgcaggagggcagcagcagaagcagcagaatggaggaaactttttaaagcagaagcagcgaggatggatagcgttgcatcgcacgcttattactactctctgcttccaagttgttgcaatgcaaacagacccgtcccctttggctcccttccccaccttcccttccttgcgcgcgcacacagcatatgaacagatgcgctctctctctctctctctctgcttcctgactgtgcctgtgtctgccactcccattaataccaaccccatctcgctcccacttcagtccacactcaagtagtactactactccattccgcctcctccacccttcccttctttttgcccccctaccatccaaccatccaagaaccccctttctctctctctctctctctcaggcaagaaacggcgctcaagagcaagaagttgctgccatggcgtgttgatactcttactactaccaccaaaaagctgtgcacggacaggttaaagcggtgtaccgctgactcgcgcggccatggagggggagcgggagggggtggtggccaagaacgaggacaacgcaggcggaggtggtggtggattaggtacaggtggtaatggtggtggcggcggcggcggcagcgcgaacgggcggaggaggtggaggggcgggggcagcagcgggtataggcagcacccgatcatccaggcctacccggcgctcctgccgctgccgataaacggcgccaccggccacgcacacatcaacggcgcggtctcgctgccgctgcctctgccgccgccggtgctgctgtacctgcagccgccaccgccaccgccgctgctgcccctgctccccaaggtcgccgccgccacgttctacggcaagccacccaaggcggccgacgcggcaccgaggggctcaatgtggaagcacaggccatcgaaaaagccgccaccgcatgccattaccgccgcgctgctgccgctcccgcggggtaaggaaggcgctcctttttcttggttacttcccgccgcattgcgctgcggccacccatttaacacctcacaaagcagcgtgcaaacacaataactactagtactagttcatctctcctactagcatctactccatggtccatgctacactagctgctgttgcttttgttggattcttgatccatttacccttgccttgtagctcattttttattctcttcttccgattatgtctttatagggtgtgtttagttgctgaaaaaagttggaagtttaaagaaagtttggagtttggaaaaaaagttggaactaaacacgcccatatatatcaagaagtggttaatgtatagtagcaaacagttattataatggtaatagaaggatgatttgcaacagtattttgtgatcaatgcttcagtgccagcaagttttcttaggaagctgtggttttatggattcctgctgagattattatgtttcatcttgtgccgtcgctatcatactgtacttgcctgaggcagccaatgttgtgtgattattgatgataccttttcttttgaaagttagtaccccttcccctctcaaggaagggtctgaccatcttttaggaaggcactccctttttttaaccaatgatgtaccactatcttggtgtttgtgcatgccatagaaaatattattctacttattgatttattattgaatgatatttccctctaaccctgtcttttgatttataattttctctagatttaatcatcggtaaaactgtttaaatttcttcttcttctggctccttacatgaaggtattgatttgctaacagatggcaaggcgcttcaggagaaaatattcttcgcaaatgaaagaaaaacatctgaaaaggaggtaaatcatgtagacacccatgagaagtttactgttgcaccactggataatgcaatagcacggagacctgacatgggtggtgttgagggggccgagatccctctttctgcaaaccatttccttgtccagtttgatcctggccagaagattttccattacaatgttgacatatctccgcgtccatcaaaagaaacagcaagaatgatcaagaaaaaattagttgaagaaaatccaagtgttctctcaggttcccaaccagcctttgatggccgcaagaacttatatagtcctgttagatttcaggaggacagggttgagttctttgtcagcctcccagttgcattagcacgatgttcagtagttaaagaggatactggccacatgcttgacaaacagaaactcaagactttcaaagtgaatgtccggttggtttcgaagttatgtggtgaggacttgaacaaatatctgaacgaggacaaggatggcatccctcttccacaagattacctccatgcattggatgttgtgttgcgtgaaggtgctatggaaagttctatccttgtgggtcggtcactgtatgcacgctccatgggggaagcaagggacattggtggtggtgctgttggattaagaggtttctttcagagattgaggccaaccaagcaaggccttgcccttaatgttgatctctcactctcagctttccacgagagcacaggcataatttcatacttgcagaagcgctgtgacttcttgaaggaccttccacagaagaaaacaagggctttggcagaagaggagcacagggaggtggagaaagcattgaaaaatatccgggtatttgtgtgccatcgtgagactaatcaaaggtaccatgtgcatagcttgactaaggagacaacagagaacctcaagtttcgcgaccgaagtgggaaggatcttatggtggtggattacttcaaggagcactataaccatgatatacaattcaggaaccttccatgcttgcagattggcaggagcaagccatgttatgtgccaatggagctttgtgtagtttgtgagggccagaagtttcttggcaagctgtctgatgaacaaacttctaagattctgaaaatgggttgtgaaagaccgagtgaaagaaagggaatcataaagggtgttgtcaaaggtgcatttcatgcaagaaggtatggttcttcattcttgtcattttcttttgcagcagttttgagctatagaaatcacataaatgtaagcgtagctatcttttttttattgcagcgatacttatgctgatcagtttagtctccaagtgtcgaaacacatgacgaaactctctgggagggttctcttgcccccaaaattaaagcttggcagcagtgggcgcatcaaggacataacaccggaccgatttgatcgacagtggagctttctggatagccatgttgcagagggttccaagatcaagagttgggccttgataagttttggtggcaccccggagcagcacttttgcattacaaagtttgtgaaccagctatcaaatcggtgtgagcagctaggaattctgctaaacaagaagaccattatcagcccaatatttgagaggattcaactactcaataacgtgggaattttggagggcaagctcaagaaaattcaagaagctgcatcaggcaacttgcagttgctaatctgtgtcatggagaggaggcaccaaggctatgctgatctgaagcgaattgcagaaacatccattggtgttgtgacacaatgttgcctttactccaacttgagcaagctgacctctcaattcttgacgaatttggctttgaagatcaatgcgaaactcggtggctgcaatattgccctatacagcagctttccatgccaaattcctagaatatttttgtcggaggagccggtgatgttcatgggtgctgatgtcacacacccgcatccccttgatgattcaagtccatcagtggttgctgtagttgcaagcatgaattggccgtcagcaaataagtacatctccaggatgagatcacagacacaccggaaagaaatcattgagcaactggatgttatggctggtgaactgcttgaagagtttctaaaagaagtggggaagctcccaagcagaatcatattcttcagagatggtgtgagcgagacacagttctacaaggtgctgaaggaggagatgcatgcagtgcgcacaacttgttcgaggtatccgggttacaaacccttgatcacattcatcgtagttcagaagaggcatcacactagactcttccacagggagaggaatggcagctcgtcacactactctgatcagaacataccaccaggaacagttgtggacactgtgattacacacccaagggaatttgatttctatctgtgcagccactggggcaccaaggggacgagccggccaactcattatcatgttctgtgggatgagaataacttccgttccgacgaagtgcagcagttgatacacaatctttgctacacatttgctcggtgcaccaggccagtttctcttgtcccaccggcttactacgcacatctcgcggcatatagaggcaggctgtaccttgagaggtcagatacaactatgtacagggtcagtccgttgcagactgtgccgctacctaagctcagagacaatgttaagaggctcatgttctactgctagcttcaccgccctgaatttcatggtatcgggactctcctacagtaattttcctcccaaaaaaaaaggtgtttcagatgttatctttaacgtatatcgcctgtcatcgtgtttttctatatttgtccgaattttggaaaatatgtatagtgctcctggacagaaatcctgtgcatcataacatcttacagcagttggcacttagtatttatgcaaaaattctgaaaccaaactgtttcattcccatagatgatgttggtaaggtgggggtttacctatttgtacagtctggatagtgaggaggtcctggagatgaagatactgctgtcgtgttccaaatttaatttcgtttaaattactgctaattttgtagttgcgttccaggccacacaattatgtgtaatacactacctagatcattatgggttgttgtgcattaacagttcataatcctgcacaaacatgcatcatgtagataataatcaaattaaaaggtattaattttgtgaggatgaatatatttgatctgaattataggtggaagaacattaatggtaaaaccgtgcttctatatccttctagccatcaaatgacaaggaatttacatgaaggtttagatcgtaagggtttattcggaatacaacatagaaatttgttaagattgtatgtgtgaaactgttgatgaaaaattcgcgcttggccgatagtgatagatctgtgttggtgcaaactaagtcgacagatacagcggcctgggagatctgcttatctccaatgcaagtccaaaatattgatgagatataggcgtgctagtcagtttgatcctgcaatcgataagatgtgtaaattgaagatcaaagagccgttagctattaagtcgatataacaatgctaggcaatgccactaccagccgatgtcgataggattttgagcaatcagctatatatcaaatgtagattttggcacttgagttaataatgatataaagataatcggctgatgataatgtaataaaacaataatgtaatccagtagaaaccaatcggtcaataatgatataatagagtaattgcttgatctgaaggttaggtatacatcggctggtgttccgatgtcattaaatccacaagattagataatcaatgaaacatttgttgcaatcggttaaaaccaacttgtatgtaatcctcgtaaaccgatgcactgtccagataactcatcggcatcaaagacatgttagtttttatgattctaagcacgacttagtaggtcaaatgcaattgatgcagtactaagtatgaaaagaagaataaagtctaaacaatcaagtctttaactgattttccgggtgatggataccttag

SEQ ID NO: 923 - DNA, 8774 bp, Oryza sativa
cacagagttctcaaaagcagcagtacatttcagagaaataaaaaactaatcttgcattgcctccacgcctacagtagaatctctctctctctcgagagagagacagctttacactgttcaaagctgccacttacccccaaaaaacctttcagttttggacagctcatccctgttttaaacctaaaaaagagagtgtgcatgcgcattagaagtgcagaagtgatctgttcaagattaatgcaaaatcctgcaaattactcagtcagttcaaacttgctatagccaattctgaaaaaaagtagtactatcatttcagaaaagagatttgctgtaccttgccaagtctgaagaaaaaaaaagaactaaaaaaacaaccttttctttttgcaaagggattcagaaaaagagaccgacctcattgtttgacttaatgcttatacttatataagtcaaaatttaaattttacagcttaatctgaatttgaccttttggttttctggtcgtagtttattttaccgtatctgtcttttagacactaatgacacgtatataaaaacttcacccacaaataatcttttatatcgggtgtgtttagttcacgcaaaaattgaaagtttgattgaaattgaaacaatgtgatggaaaagttgaaagtttgtatgtgtaggaaagttttgatgtgatggaaaagttggaaatttaaataaaaagtttgaaactaaggctgtgtttagatccaaagtttttcagtcctttttccatcacaatgatcacatcaacctgtcatacacacaatttttcagtcacatcatctctaattttaaaaaaatctaaactttacgctgaattaaacacagcctaaactcggccatgataataaacgattgggataaacatataaataagaaacaacgagactcttgatgtaccaagccgagtctgaagaagagaaaagagagagagttcagaaaaaggaaacgaccctattctgatcagaaaaattcaatctttctctctctttctctcagaaaaggtcgagagagaaagtggatgtcttcatgtgaagaccagagagaagacgagaggcgatcgcagtggagtggagtgaagtactagcagtattaaaaccagcagcaagcgagagagaggccaccaaccacttcctcctccaagaaaccacccccaccacgagcacgagcacgagcaaccatggcggtggcagagggagctgcgactgcgagctacgggccatgactgcggcgagttcttgctgggttgttgttgtacaagcagcgacgaggaggaggggagcagaggaggaggaggcggagggatggcagcggcggcggtggggggaaggggggagaggctgtcgtcctcctccccgacggcggcggcgccgcaggtggacgccgggaagtacgtccggtacacgcccgagcaggtggaggcgctggagcgggtgtacaccgagtgccccaagcccagctcactccgccgccagcagctcatccgggagtgccccatcctcagcaacatcgagcccaagcagatcaaggtctggtttcagaatcgcaggtcagtctcatctccttctctctcttcgatctgtttctgctcgggtttgttcagcagccatggcgtgtgttcttcggtttcttttcttggttttgtgtaatgtgatgagattgattgctttgttgtttgcagttttttttcatgttcttgtgggaatgggggatcctttgtgaggaagatttgggttcttgagatgagttttttttttctgtttgatttgtagatgtctgtaactttttgggtgttgattttagggcttgcaatgtgttggattggtgacgagaaggttcatttctgggatttgcatcctatatgatgggttttgtttttttagttcgtcttgtgcaataatgaagcgcaatctgtttgcttgaaatttatcaggatattttcttttataaaactttgcggcaatgatttgagttcctgtgcccacactgttcttcgctgcattattctgctgggttgtgtggtgggtagggagcgaaatggcagcatcattcgttggtttcctcttggattttgtggtgatgtgaatagccaaatatcctggatctctgtacagactttacagttaattttgtttggtttaaattgtaaatatatgctctctgattgttttgttgcttgtggtgaccaatgattggttggagcaaaattgccttaggtcatttcttgtttcctgtgcttgccattttaagggccatctttttaaccctgtgttgtgggctgtggtagtgttcatgttttcttgctataggcctccataagcatcacctcctggttatcatctcgctttcttttttcagtggatcacaagtagggcaatagttttgtcactggtggtgtcactgtggaagaatgtgaagggcaacattttgagcaagtttggtatatactattactgtactcatgaaggccaaatataaatcaagaatcctttttaggtagaggatgctcttgtttagagttgagttcacagatgcagacagaaacatcactgtcaattaggcaatgattttcacatatggaatactaactgttattgcatagtatatagtcatttgtctcttttgcaaatgaccttttgcttgttcctgttcaatgatcccccttttaaccttggggaatatttgctaaaatgcctttgcctaacttcctttgtgctcatttgggctgtgccaatcagtatccattaacaagtattggaatcttgtgtattagaagacaccatcctttagatagtttattcatgtacttttgccactgaaattgtgccttccttgtaattggcagatgccgggagaagcagcgcaaggaggcctcccggctgcaaactgtgaaccggaagctgaatgcgatgaacaagctgttgatggaggaaaatgaccggctgcagaagcaggtgtcccgtctcgtctacgagaacggctacatgcggactcaactgcacaatgtgagctccctgtgcttacaggcttttgttcttacaattgcttcatattttgatcatcctgttttcttaatcagtaatgtttgtatgtactttgtagccttctgcagccaccacagatacaagctgtgagtctgtggtgacaagtggtcagcaccatcaacagcaaaacccagcagttctgcatccgcaaagggatgcgaacaacccagcagggtatccacaaaacctggtctattttcttcttttgttaggccgtgcttttttgtatgaaagattgctgagatgattttatttgcgcagtcttctcgctattgctgaggagaccttggcagagttcatgtcgaaggcgacaggaactgctgtcgaatgggtgcaaatggttgggatgaaggtaatgtattcgttgtacaagaaaactgtgcagtatgttgattttctctttccattcatgttttttttgttcaaatcaactgaaatgaaaatttgattacagcctggtccggattccattggaatcatcgctgtttcgcacaattgcagtggcgtagcagcacgagcttgcggcctggtgagccttgagcccacaaaggtatgatttgttttccttgatattgtgttacatttcccattaactggcatgctacagaccctgataagcttcattttaggttgcagagatcctcaaggatcgcccctcttggtaccgtgattgccgatgcgtagatatcatccatgttatccctacgggtaacggcggaaccattgagctaatctacatgcaggtaaatatacccaatcgtgactcatgtgttgcatttttctcaagcatcactagctactctttgtttttggtaataaccattgcccttttcaattccttagacatatgcaccgacaactttggcggcaccacgcgacttttggactctccgctacacaagtggacttgaagatgggagtcttgtggtattactttgatctttaattgcatgctgtcagctcattaaacaaaatgcttcctttcattttcttgtatggtctattcgtcatgttatgatcggacttgttctgtttggatcataccacatcatcatggttttcaactgaagtgtagtttctgttgtattaaatattgtttgacaccattcctgttctgtagatctgtgaaaggtcattgactcagtccactggtggcccatctgggcctaacactccgaattttatcagagccgaggtacttcccagtggttatctgattcgaccatgtgagggaggtggctccatgatttacattgttgatcatgttgatttggatgtaagtaacaatagtgttttcacattaactagtgtaatattgaatagttttgagatacatatcttattaatcctgtgtattttacaggcttggagtgtgcctgaggttcttcgaccgctctatgaatctccaaagatccttgcacagaagatgaccattgcagtatgtgcactgttttattctgttgttgaagagcacttggtcacctcatggtgattgtgagtgcataacttttcttatcaccaatgacatggttcattctgttcaggcattgcgacacattaggcaaattgcgcatgagtcaagcggtgaaatcccctacggtgctggtcgccagcctgctgttttcaggaccttcagtcaaaggctcagcaggtctgtagctatttgagggttcccatgtattagaaccaattggcatactgtcatatgacacagttccatgcatgtctcattgctcacgcatctgaactccatactctaatttgcagaggtttcaatgatgctgttagtggatttccagatgatgggtggtctttgttgagcagtgatggtagtgaggacattacaatttcagtaaactcgtctccaaacaagcttgttggatcccatgtcagcccgaaccctctgttttctactgttggaggtggcatcttgtgcgcaaaggcatcaatgctacttcaggttgacataggctctatttagttgctcagctaattatagattgtctctatctttgtttcactttgaccaaaattgttccaaatcaaagaattaagctttacaaaatgtcattttttttataatgtagaatgtacctcctgctctacttgtgcgatttctgagggagcatcgttctgaatgggctgatcctggtgttgatgcttattctgctgcttctttgcgagccagcccatatgcagttccaggcttaaggaccagcgggtttatgggcagtcaggttatactacccctcgctcataccttagagcatgaagaggtaatgttgtaattgagtccttgtaggcttgtagctccttttccacaatgaatggcaaatattaatgcatcaacctggcattctgaattgcagttcttggaggttattaggctcgaaggacatggtttcagccatgatgaggtgcttctatcacgggatatgtaccttctacaggtattgtggaccatccgagtcaactatttattcctttgctgttgggctggacaagtgggcttcggtgggaggcatgctgctgttcttggccaccgtatgggcctaaccttctgctcagggtttctggtggatcaggtcctcctgcgcatgaattattttttatttttgttcataataaaagctgagatgtaaaaggtttaagagtcttagtttaggttatggtgcttcgttaagtctagcagggtgtgctgcagctcgaggacgagctgctcaaaaaggggggagtaatgtcatgggctttgggccgggcgtcctaggtccattggataggattagggtttgttaggattagataaggtttgttaggattagattaaggagtcctccatctatataaggagggatcctatctcaggtcaattaggcattagatcaagatttatcttagtgcccatcggcctgccttctcagtgcgacggagagcgtcgcgccgtttaggttcaggaccgtattccttgttatttcatctactataatccaatctatccccattcatcccgattcttctccacataatccttgctcatgacaattgccttaagttgtacctgtttgttgcattttcctggttctgagagattgctttctatgcagctttgcagcggggttgatgagaatgctactagtgcatctgcacagcttgtctttgctcctattgacgaatcttttgctgatgatgcaccacttttaccctcaggattccgtgtgataccactagatacaaaaatggtatgactggtccataatcttattccagaggccttgtctttcccatgttggctcaccaattaaccgttatgcactcaaacctgcaggatgggccatctgcaacacgcacgctcgaccttgcatccgcccttgaggttggaccaggtggagcttcgcgtgcttcagttgaagcatctggcacatgtaacagatcagtcctgaccattgctttccaattctcatacgagaaccaccttcgtgagagcgtggcggcaatggctaggagttatgtcagagctgtgatggcatccgtgcagagggtggctgtggcaatagctccttctcgacttggaccccagatcggaatgaagcaccctccagcctctcctgaggcgcttacacttgctagctggattggtaggagctataggtaagtaaaatacttatttttagcaaaagtctatctcaggttcttcatcatcagaaccacctacacattgccacatctgaagttgtgatcaatgatgttaatgcactagttatttccgtggatctttcagggctcacaccggagcagatatccgttggtctgataccgaagatgccgattctcccctggcgctcctgtggaagcacagcgacgcaatactgtgctgttctctgaaggttagtagtgctgcccactaattttatgctcatttcatcacatgcatgttctggaaaccttgctaatggtcagtttggttatctactggcagcctgctcctatgttcaccttcgccaacaatgccggcctcgacatccttgagacgacgctggtcaacctccaggacatctcgctcgagatgatcctggatgacgagggccggaaggcgctgtgctcggagttccccaagatcatgcagcaggtaaaaccaccgtgtccctgcctcgcgacaatcggtgacgcatccatcagagtactaccagaccatgagcaatgttcctgatcaagcctgtttggggtctgtctatcttctttcagggtttcacctatctccctggaggcgtctgcaagtcgagcatggggcggcaggcatcgtatgagcaggcggtggcgtggaaggttcttagcgacgacgacgcgccgcactgcctcgccttcatgctcgtcaactggaccttcatgtgatccaccatccatggtttccagcttccagctagtgcttttgcttttgtgccattgtggcaaactgaacaaagacctgaataccaccaccgtattgtattaaacatatgcgtccatacatgcatggtgcttgctttatcctagctagtgctagcacctgtgtgtatggtctctccatgtttgaagcttaaaattttagaaccctggtttttttttttctgctgctgtgtggatgaacaagtttcaggacctatgtatctctatctatctatgctaatgctatgaattgtgtgatgtgtgtatgctttgagcaatcggcattgagttaccttggttggtttatgccgtgctgaaccattgttgatgcatatgtagctgaaggaagtatttgctgaatgtgattcgtattcctccaccgttaaactaaaacaaaagcgtttctacctatcaaaaccggctcattatgctctcagcttaaaccattatcctttgctgattgtggtacatagttgagggagcccaaatagacttttctcagtgctacgtcctgctcactgatctcggccacgaatagaatcgtgtcttgtttgggcccagttgcagcccaactcagcctatcaccggcccacgcacgtgcgcggatgtctgtcgatccaccacctcctgcctcgcagccggcgctgacgccgacgccgcgggcctcaagtcgagcgatctcttctccggcgatctctgccatggacacagatcagcagctggaggaggaagaatgccaagaagaagacatgagcagcagcgaggaggaggagaaggtggtggagcgcttcgccgagggcgtggaggcggaggcggcaattaatagataatcaatcgaaaataatttatgagtacaattttatgtcgtgttcttaataatttaaagccaacgttgaaaaacaaattacaatgagaaaaacaactctaaaattaagtttcatattttaaaattgggctgcaattaataagccaacgagcaatgaaaatatgagacatacttttcagataacaaaagaatagctttacgtttctcattacaatccaatctctatctctactattataaaaattgaatatgtttttgctggtattttcgtacgtcatccgtatttgagtcggtttttaatttcgttcgctttttaaaatacagatccgtgtttgagtcggattttaaattcgtttacttttggaaatataaaaatctctttaaaaatactgctaacttaaaatgaaaatcagacttagttcatcaaatatctaggcgaattgccaaagtga

SEQ ID NO: 924 - DNA, 6758 bp, Oryza sativa
agcacgaccatcaaaaccatatgctcacaacctaccatgaatatggttttagttgttaagattaattaactaataatgattaatcattgtgagctattattaaatggccataattaattatagatgaagcattaattatcccaatagtgtactaatgtttctaaacatggcttaagcctcctaataactttagctaaaaccacatgatgttgtagctaatcaaatggcccgattcgacctcttctccttgctctctaccaccgccatctcttcttacacatggatggcatggcaagcgtcgggacacccagatctaagcagagaagtaggtccaacaacatctgtcctctggatcggttggtgctaaggtggtggatatctgagcgtacccaacacttacgacgtcaaatctgatagtcttattcatgggatttaataatttctctcttcttccttcttttttttcctccatctggaagctttcatttttttagacggctgcaattctcctccgctatattcgctagataacatggctcaattccttctacccgtcgggagcacggaagcaaatactcgaattttaccacgcgtttctctccccgataaaatggctctgaattcgtacgacgagtctgcaaaatatccaatactacccaatgtgcatcgcgtagtaaacgcgctgccgtcaatacctggaattctccgcaaaacggccaaaatcccggtcattttccgcgcgtttgcttgcaaacctctcctaactaccaggccgcacaacaaacgaaccgaccgggcctgccccttcctccatagtagttccatcattgtctcgaagcccgagttcgacacgtgcttacgctagtccggcagaccgggtggaggcggatcttggccttggctcgctggctcacggtggacgatgtccacgtgctggcccccgcgcagcgttgggctcgcctcctccactcctctcgtccacccgaggatgacgtgcacgcatgggcaagcgagaccacgaggtcgccggaggaaccgtctcgctgcgcggtggttcccacctccgcccctccccatcgcatctcgcgccctataagcgagctcagctgcccgctccctctccgttctgagctcgcagttctactagtttagtttttgcgaagtgttcttctccaaatcacctgagaaataggtgtcgattttcaggtatgattcaccgatttctcactaggagagagtaatctgtaattaggtgtttgctatgtctttttttcttcctggggactccctggcatgtgtgtactactcgtgcggggaacagttcccgggtttcgcatgaattgctggatttggaattggtttgctggctggtcgaagctcattttcgctgtgtagattagttttattctcgagaacttaacccatctgtttgatacagttaaaattttggtttcggttctcccgatcaaattaatctgaaggctgatagttcttggtttcagtttttcgagttcgctcttttaaacgtatctttcggtttatctgttgcagaactagcgtgctagccactagtgtggccatggaagtggtttcttccagccactcctgcttggcatttaaccgaacacctagcagtgcttggaggtttccggggaatggtcttggtccagggcatgcaaagctcactcggccaagaagtgcaattctttgtgtgcggtcagggacagcttcgaatcctgctgattctgggaaagttcatgcgagccatgggttctatgtaagtgatgtcgatgcagctctccaagggatcccgaagaaagtcggtgagatcgagaagatgatcattccgagcttgccagaaggacctgaaagctctctaattagtactggtttctgggaatggaagccgaagctgagtgtatattatgaaaagtctggcatagacaatagcaaggcaccgtctgtgctctttctaccaggttttggagtgggaacgttccattttgagaagcaattgaaggatcttggccgtgattacaaagtatggacaatggattttctagggcagggcatgtcgttgccatgtgaagatcctgctcctaagagcacatcaggagagctagatgaggacacatattggggttttggacaagaattacaaccatgggcggaggagttggtgtattcgatagatttgtggcgtgaccaagttcagcattttattgaagaggtacttctttcaactattttctgtgtagttttatgtttactttgctaaaaaaatatcatctttagttcacaaatcctagtatgctttgcactctttgaagggcctgcaataatagctatttattagttattgaagattcttgaatctcacaaacttcagcgtttcatattcggttaatagaatataagaaccgttatgttgcccaaagcaggtgccctgttttttggcacacacacttgtaacacattcttttattccagtatctagaatagagagcaaaggagccctgttcccaatctcatatagcaggtttgacatttgtgttattatgtgtaatgccaaagttcttaagtttacttatccataacagtcctaccatgagattcatatcatatgtttcttatgctaattttgtaaccttctttcaggttattggtgaaccagtatatattgtggggaactctctgggaggttttgtttctctatatcttgctgcatcctgtccacaccttgtaaagggtgtcacattacttaatgcaaccccattttggggattccttcccaaccctgctacatctcctcgcttgtcgaagatttttccatgggctgggacatttccacttccatcgtttgtgaggaaacttactgaaacagtgtatgtgctaccctttaggttttgggaaacacatgtgcatattgatattgaataatcttaaatttatcccttctgctaattattggtgtactattttttttcattataatgaatgcatggaatgcaaaagttttatgatacttgtagcaaggcatagcatctgtagattgctaccttttgttttgacagaaattgattgcatacttcaccagtgaagaaacgatttagactatgtttagtttgcatatggtactataagtatagctaataattgttttttcaaaaaaaaaacgtgtttttttataaaatcacacctagatataaagtatatttctgtatgtcattttctgccattatttttccttttacattgtcattcctctctcatgttaggatggtaggctgtgcaatgtattggtgttttaacagattaaacaagctgttattcaatagcaattgtgtggtccctgcatcatttagaactatgcaagttatccatgtggtgatataaatttggtggatctcatttaatatctttttggtgcaggtggcagaaaataagtgatccaagaagtatacagggcatactcaagcaagtatatgctgaccactcaacgaatgtggacatggtgttctcgcgtattatagagacaacacaacatccagcagctgctgcatcatttgcatccattatgtgtgctccaaagggacaaatatccttcgaagaagctctatctaggtaaactggatatactatttgatgaattgccatgttgcttacaaaatacgattttgtatttttacatttcataatctgcaggtgccaaaggcagggtattcccatatctcttatgtatgggagagaagatccttgggttagacctatttggggtattaaagtgaaacagcaggtgccagaatcaccgtattacgaaatcagtcctgctggtcactgccctcatgatgaggttcctgaggtaaaacattcattgtgtttggaaataaagctcgtcatatttagtttgtaccagatagttgatagttcattttgtagccgtgcattctgttttgggtggatactgtggctggtgggctgtgtgtgtttaagaaaggtcatgttctctgaatatcatccatgttgattacacataagaaactatggaacaaaaactggaggaaatttgtatcagtatctagtttgttttgaccaacatttgaaatctctatttaaatctagaaatttcggtatacaaccaatggccattatatgggactgcagccttagctatgagtttctacaaagataggcagctgtatcttagaagctaaatgctattagtggaatcagatctggatcagcacaacaggttgtcagatgctatctttaggtggggtaccagggaagcccaagaatcacaactgtttgcgaattcctcatgataggattttctgctagggcaatgaatatggattgtaccatttgtaagcttaacattttttctgcagtttttgtttaattctgtagcatgcatttgatacaaagacaccttggggcactaatttttttatggttgagtgtgtttaagttccctagttttctcctttgaagttacaagacattatatggttgaggttgtaggttccaggaaaaagccttgcctggtggatcactgggcgccttcaggcatcgtaaccccttggggcggtgcgagggtacctctcttcctcggcaagttttctctaggtgaaaaccacatctttgttagaaggtgggcgatggtgccgtccttgatggcgtgacctccgtggtggcatcgttttcgaagtctcgtctttgtggtgttgtcgtgggcctagcggcgatcagccacgcatagcgagggtcgttttggtgctaggcttcactcagtggtttgtgcttttgtggttagcgtgtggttttaggacgtgccctgtggtgcgcatccgtcctcgacagctttctgttgtgttttttcttgtaactttttctccttaatgcattcggatggcctcctttggccttcccggcgaaaaaaagtggcaagacatgttctatgttttttttctttccttttttaatctgtagagttagttcaattttctgcatttatataaagatatatgtttcacattttactcctcacatattcctatttttgagagtgccttcttctgtttaatcattcatgaaaactgcttaaggattgtctctgtgatgacaaaatatatatatgtcctttacatatgattttggtctttggacaggttataaactacttactcagaggatggctaaagaatgtcgaatctgagggttcagttgcagttccatttcttgaagaacccagctatgctgaaaatggtgtatcaagggagctggaatttgttaggggaggatcaaaaaaatctgtccatgtgcgactctttggttctaaaatttccttatggagccaacttcgttcgcttttgaagtccaacacatgggtaatatctagataagatagattgtccatacaagtatgatgttagaagcttcagtcaaatattgtattcattattctttatttaaagtagtcagtttgatgtctagaactctagatatacccagtagacaggattttgaacatttctagtggatgtaaaaatagcaagcttcaaaattcttgtgccagaacaaagggagtagccaagtttagtccttgtttgtataggctatcaatctttatcaagttcaaattgtgatttctgtataagcagaaaaattggtatcatatgccattgttataggatccacacttcactgtccttagaactttcagttctatatcaactcaggtgctttttttcaaaaaggtagaatggaccatgtggaattgtggattatgttgcggcttaatggataactcgtcattttgacaggtttaagttatgttagattgttaggtgcaattttgtcggaattgtagatccgccattgtgttaatatgtgaaagaaacagcgaaagtggaataaaaagagagaaccttcagcagtatgttcagaatgttggatcatttggtgtcagctacgtaactgtttttttccccttcatcattgcaacttggaaggccctccaggcgctgcttgttggggtggaacggcattccctgaccagtagctaaaagtagtttttcatattgtaagatgctttgacgttttgggttttgaatggatttatgcatgtgcttcgtatatgtgtcgaatttcatacggatgttagtgtatctagacgggtgatggagagactaacgttcttgtagtataaaacacttacaaaacacagagtatattttagatgggagtaatatatattttagtgacaatttttttttctaccactagaaaaaatacctgtgtgttacaaggtgaaggctattttaattgtgtcattgttatacaatttaattagggtcaaattcactgtgtgaatttagggccaaattcactgtgggaattacttgaatattttctttttagaaaatcataagctgtaaattttggaaaatagaatacaatctgtttgttgaattgcgttgtgtggaaatcatgatttaaatagagcatggtcttctagtgtctcatattatgtgggatgcacgatcaatcctaggcaaggcctagttcccaactttttcttcaaacttccaaatttttcatcacatcaaaactttcctacacacacaaacttctaacttttctgtcacatcgtattcaatttcaatcaaacttctaattttggtgtgaactaaacacaccgtgtcttgtgttgtaaagaaagtttgtgtcttaaggtttttctcgagagattgtcc

SEQ ID NO: 925 - DNA, 5357 bp, Oryza sativa; identical to SEQ ID NO: 264

SEQ ID NO: 926 - DNA, 6955 bp, Oryza sativa
caaaatattaatatatgggattgtacagcccctttggcataacatttacgttgttgggatattattggattttactaacagcaacagatagttaaacctacgagcttgctaattatcagtactcgcttcttctcttttgttattgatttgcaataatgcactaaaccgcaaaacatatatggagttatggattattactagtaagtttgaatatttatagttacgttattgctagaatttacaattcagggtagcacgcataagaatatctaggattgtacgacccgtggacattgcatttgcaatcataggatattgttagattctggtaaaataattggtactcacatgatgttatagttccttaactaattggtatagtatccaccaactagattgctgcttcaacatcactcatgtttgctcttcgattcactaaactgcagtgcacatgatgttatacagttccttaattggcacccctcctaaaacttctacaatttaaaatttgtgctaaggcatagcaactttttttcacctcaaccagacacaatcatctatcactttttttcacctattttacttatctcaaccagtgacaacaatcccttatttaattttactatctctttaatatccgtaaaaatctcaagtatttatgtttttgagactgacagagtagtctactatttttcttgcaatttgtaaagtctactatttttcttgttatttgtaattacataaattatacgaattgtaaagatttggcacattttttcaagtgaaaatgccacttgttactttttaattatgcaataaaacctccaagctgttgcttgagatgaactaaagtcaactaaaaaggcagctttgggtgtcttgttacttgtagtagttttttaatatcaccttaatttacttcatacacatagctgtgtgatcgcagtaatgaacagatatacacgaattataccggcattaaacatgaaataaatatacacatttaatcattcctataccaagggctcattcctttataggaaagggctggggaaataaaatctaaccaaatttatgcgattattgttccaactccagctcatgctcatcaattcaaattaagtagaaattaaaattaaattccaagagcagctcacaacagcacaaaagaaaattaaaacttgcctttgggaatccaatgcccactcctccccatataaatcacacccgtcgcatcgctccgattcccaatccccacgcttccattccatccatctctctcgctctctcgcttgctcgccccgccgattcccgatcggagtgaggagctcgccgctgctgcttgccatggcggccgccgcgctgaccagccagctcaacgccctcgtcaacaacatgttcgccatggtgagtgaggcgcttcacacgctctttttacgaattttttgcgccatttttggcggaattccgggtgtggatgacgagatttttttggggttccatgtgtgatgttattgttggattgtgtgtattggggagttagggtttgctggacgaccagttccagcagctgcagatgctgcaggactccaccgcgccggacttcgtctccgaggtcgtcacgctcttctgcgacgacggcgagcggatcatctgcgagctctccaggcagctgtgcgtgtaactgtttcgcttgcttttgatcggatcgttcgtgttcgtgttggggattggcttgattttggtttgggagatttgattgctgcgtgtgtgtgtgtgtgtgtgtgtgtgtgtgtgtgtgtgtgtgtgtgtgtgtgtgtgtgtgtgtgcagggagaagccaaatgtggattttgacagggtggactcgtatgtgcatcagctcaaggggagcagcgcaaggtgagcttttcccctgtccttttctggatatggaaatttatgttgttatggataattattgctgttattgtcacttggcgcacgaaattgggtatgagatccctttcgaatgggagaatttaaagcgttgtgcgaagcatgtagtcaactttgggaggattgtcatatgtttgattattgcatcttttatggcgtagaatctgacaaaaatggtccattccacccaaagtgattggacagttcgaagagcagcggttcacattgttctatcatatgaattgcccttctgagcaatttgggatgggttgtcgtccgtttgatagctgtatcattctatcatgtagatatgacaaattcagtcccgctcccatgttgatcagacggttcaaatagtagcattcatattctcctgttccttgtggtgctccagatctattcaaggaggattgtcatatgcttcattgttccagcattccttgacatagatctgaaaacatgcttctgttccatcacacttattgaatggttcgaagaactttcctccattccaaaatgacttggtttacacgtgagagtcctatagtttgaaatgcttcatatttacgaatattgtatctaattttacttagaattctattttttgttatttttcaaacccggagtgttatcacattttagattagttggtcattaaaaggtagactgctagagaatatatcatagattagtgagagaagggtctaatggtattcctaagtgtatagaccataaactacttcaccatggatggtccttcagagcttctatgcaccatatgcacaaacagtagtaggatgacacagcatgtaaaattcctgtttaaatgccttttttttttttccttttggtgtagtcatggttttgtacctttacaccttccttcctcgagatccctaatttccctatacccgaagatatcttcctgatggctacaaaagaaaaatgtttccatttgagatttgtttactgaattttggagatctccttacttggtcatatctgcaggtgctatcaaattttcttcttgctccagatcttaatagtacctagaatttaatcctgctctttatcagtatatcctcagaatgatgttttaaggtacattttgtaagggtacactgaacctattcaaacaggttgtctggagtttatccagattagattttttttcttgaaacagaaatttaaataagaaattgacaaacaaatcctttcgcctattcaatttgggttcaggtatatttatgtactggagtgttattctacagaatcaaattatgtatgaaaataactcaccatggttcttcatgttagatctccttatatatttagaactggaactaccaattggcattcatacacatcactacaaatattaaatcttgttgatagtaggcaactcacaagccagacggaaatgatcaataaaaacatgcaaatctgatagtaatatcatcgtcccagaatttctagtaggtcaatgataatattgcattgttgaagatataatcaaatttgttgctcgtctttccattaaagcatttgaggagccttcctgactgtatatccttgcatgtttgcagtgttggtgctcagaaagtgaagaacacttgcattcagttccgtgagttttgccaacagaggagcagagatgggttagtacctattaatacagtattcccatttttttatcatattattgcacatatcgttatatgcatatcttaacgatgatctagtgcactcttttcttacattttcctattgttagtgttttctgtggtataatgttgacgtaatttcttgcattattttttctattgtaacatatcttcatggaaagcaacaactggctgattctactctgcctgttgacttaggattgtaattgctccactccaatttccaagataatagaatcactttaaaaggtgtgactaatgtaaactctatggcaggcatgccttgatttgaaatgaaatagtttgattcttatacagaactggtagatttttcagtatttttttcttttttgaagaaagggcaaaagctttgccacttatgtattaataaagcagaagggccatgacaaaaaacatttacaaaagggaaagggaaaaacaggggatgtgatgctcgcgcaccagcccaaaaaacactacactctgctagtcgattattcccagggttttatctccttaagcttgaccgcacctgcctttacccaggctgaggcttcttctttgatttttgctagtagggtcattggggtggttgcaacatgacggataactcttgcgttttgcaggttgtccaatatgcccccaaatattttagcatgcatatttgtagtggaaccaagttgttccatcctctctgtatgttgtgcagctattcagtaaagtagggtcattttggtttgaaatcctaccaaaatatttgtagtgccaattcttgggcaagttttggcactacaatttttttggtagggtagatttatctcaactccatagatttagcaaaagttggttccaatccaaatggctaccaagtactactattcaaggctaccaaatacttggtagggcaggaattggcctcaaaccaaaacggccctaaatctacattatattgatctttatatcttcatttatgtaatagcctaaaataaaatatgttatttttgtgacaattgtccccttctttgtgttgggccttttccattatcaggtgcctcaagactttggatttggtgaggactgaattctatgatcttcgtaacaagtttcaggctatgcttcaggtattaccttgcgttcccaaattacatcctatactccctgttgtgttgcactgagttggagtggacatcttaaaagtaagtgattttgtgtaaggtttggaagtgatttgtaaggtttgctttatgattggaacattaaattgtagagatggttggatatgatggaattaatactgttactttccgtgcaacacacaaaaacaatcaacaatgattagtctgtttgctgaatgaatagcattagtcttttcatgacacatatatgaggtagtacagtggtatagttgctgtgaagcattaaatagcatgcgagataatggcagttggcagaagatgaacatggtatatttatttctttacaaagttggttttttttctttgtcatttccagtgctacatttgtacttaagcctttacgtggtaccacttggtgtggtaataattatgacttacagatatcgcactcaaaaaccttgtttgtcttataactattttattttatcccatccttgcgtgtggatatatctatgggataattccaagaggcctagagttgtttggtccccaacttgtatttttcttctcataatatgggtagacctgatcttttacctccccagtttggccctttctcatttctgaatggaaaatggtcatttaattctggcttgcatttttcgatttcttgggctgtcaaatcttactagtcttatgacctgacgatgcaaatttaccttaaccatttatagaactgatctgttattttgctttccaatgcagctggagcagcaaatccaagcttgttaccctaaacattaaactggcgcgacagtggagctgcatgtttacacaactactgtgcctttggagttgtagaacatgctcgtttagcttttatcttggagtcatttgtttctgggatgtctgtagctgtttagcaacaagctgatctagctttggcaccttcattactgagtagtcgctctcagtttctgtgatggggacaaccgtttccagcaatttgtagtatctgttgttatctggtgtctcagctatagtttttttcggtcgtttagaaatgcaacagctgtgcaatttcgcgaaaattgcattttgctggttgattagggcggcttgtggtatgttgttgagaacaaagcgatacttaatatcgatataattgctgtttgaaaccatgtgttgtgggatgaatgtgaaccgtgccttgtttatcatcttgctcaggtcaagttgaattatttttggattgacatgcaccagaacagtcaagaacacatctacaatccagcctttccatcatctggtatgattttccatatcctatatctcttgtggttgatgcaagctactccagaaatttatcctgaaacactgcatgcaaatttgcaactggttctggggagtttaggtgaaaaatgggtgagttgtgtccgttgttatgaacccaaatgaacggaacctgtaggtttggtagcatttctgcattagctggccaacatcaacatgttactccctgcaatgtacaacagattcaggtttagctgcacacaacactgaatttattttaaggcaattgctgcactgctgaggcattgagaacagcaataaatcaaggtcacatgcattgtgccacttgaacagttggaactggcccttgttgatggctatacctaagcttaggtggactcgttcatcatacatgtactataatactactagacttaggaaaagtggtcctaaatactcgtacattgttcctacttaggagaataaatgtataatagcgttgggctagctactgtcatggaataaatcatttcatttattattattatacgtctaaatttggaggcgattacaacaaattgtttcccttcttggacctcagattttttttttgtctttacatttaccgtcggaatttgcacgtgattccttcaaaattcttgtgttccaaacagggtcccggtaagtggaattatgttatttttctcctccctttgacctgaaaagatttatattttcagtcatcctaagaaaatttactagtaagggggaaataccatagtctctctggtaagtaagaggtattgaagggataaaacttcgattaaggatagatataagatgataggaatcgattgtcttttggataaattttgaacctgaaatcaagtgttttttttaatgg

SEQ ID NO: 927 - DNA, 4041 bp, Oryza sativa; identical to SEQ ID NO: 210

SEQ ID NO: 928 - DNA, 4747 bp, Oryza sativa; identical to SEQ ID NO: 611

SEQ ID NO: 929 - DNA, 4014 bp, Oryza sativa
ttttttatatatatagtatttctatacatctaaagtttatacacctaaagtttatagacctaaagtttataagtcaaaagtttacatacccgtttcaaatttgaatttgaattcaaatatccgtttcaaatttgaatttgaattcaaatatcctattcaaatttgaatttgaattcaaatatttttcatatatagtatttctatacatctaaagtttatagacctaaagtttatagatctaaagtttatatacccgattcaaatttaaatttgaattcaaatattttctatatatagtatttctatacatctaaagtttatagacccaaagtttataagtcaaaagtttacatactcgattcaaatttgaatttgaattcaaattttttatatatagtatttccatacataaatttttctaacttttattttttaaaaaattttgtgtggtctactgtagtagaaagaggagaaggggaggaggaaaggggagaagagggagaagtatagggggagggggggccggatccgatcgctgatcgatcgatcgcccattagcccccccgggaggaagaggggaggaagaagaacgggtcccacatgtcagtgggccccacattttttatgtatgaatgacaacaccgccacgtcagcgccacgtcaccaaaaccgccctccaaaaccaccatgggagtcaaattgcaccggtttcgatagttcggggttgagatatccggttttgcggtttagggtcatggattagattcggcttacttttaatggagtcaaagtggacttattcctccagctaatgcccaacctccaaagccgacgcgttggtttcaacggcttttcaaccaaagccaaaccaaaaacaccgaaacatcactgcgcccgcgcgcgcgtccgccattccctcccggccctcccatgcgccggggccagcgagaggccagaaaccgcgcgccctgttaagagcacccctcccctgcattgcactaggagaaaccaaaccagtggctaagccatcttcgatcgcagaaacccgcggtgcgtagcgatggcccggccacgcctcctcctcctccctctcctcgccgtcgccgcggcggtgctctcgtcgccgctcggccgcgcgctcgccaagacggccaagaagagcaacgacatcgtcaatggcccactgctcacctccaagatcaacgccaagcgcacgctgatcgtcggccccgaggacgagttcaagaccgtgcagtccgccatcgacgccgtgcccgtcggcaacaccgagtgggtcatcgtccacctccgctccggcatctacaggttcgtaccgataccgtcatgtgtacggttgcatgcacctatatatgcgtgtctatctcagagattgtctgtgttttttttttcctcgagctttctggcattcatccaaataattataaatttttttgataagatatattcatgtgtaaggatatcaccacacaaatactatacaaagttcaaatttgatcactagaaattgtagtaaggaatcttttgcatgcgtgcattgactgcgttcagggagaaagttatgatcccggaaaccaagccgttcatcttcgtgaggggcaacggcaagggccggacctcaatcaaccacgagtccgcttcctcccacaacgccgagtctgccgccttcaccgtgcacgcggacaacgtcatcgtcttcggcctcagcatcagggtccgtccctgtttctctctctgtctctgtgcacagtgcatatatcgctgtctctgaatcttgacacgatccttgtatatccatgcgtgcgtcgacggaacgatcgatcacagaacagcgcgcgcgccgggctgcccaacgtcccggaggtgcgcacggtggccgccatggtcggcggcgacaagattgccttctaccactgcgcgttctacagcccccaccacaccctcttcgacgtcgccggccgccactactacgagagctgttacatccagggcaacatcgacttcatcttcggcggcggccagtccatcttccaagtataacaaagcacaaattagcacacatcacccagtcacccatacatgcaaaaacacatcttcgaatggtgatcgatcgatgaacgcgaatgcgcagtgcccggagatcttcgtgaagcctgaccggcggacggagatcaagggctccatcacggcgcagaaccgcaagcaggaggacggcagcggcttcgtcttcatcaagggcaaggtgtacggcgtcgggcaggtgtacctgggccgcgccaacgaggcctactcgcgcgtcatcttcgccgacacctacctctccaagaccatcaacccggccggctggaccagctacggctacaccggatccaccgagtaatataaaatcatatatatagcgtgatcactacacatatctcaccaccttcgatcgatcgaccggtggtgcatgcatggctgatgcgatgttgttgttgttgcgtgcgtacgtgcttttgcgttgcgtgcagccacgtgatgctcggggagttcaactgcaccgggccgggctccgaagcgacgaagcgcgagccgtggtcgcggcagctcacccaggaggaggccgacaagttcatcaacatcgacttcatcaacggcaaggagtggctcccggcgtactactactgatcatatccaaccaaaaagagaaacgtagtaacatgtatgtgcgtgtgcatgcatgctctgggccggctagccgtaaccatggtgtcaagagttctaaacttctaatcgaaacggaagcgcactggaacgattggtgtctttgcagtaggaagatggcagatttaatttgttgatcatgagctcgaaatgaacttgcgcattttattgcttacaagttagaactgaggcacattgctcggtttatgactgtccagtgcatagaacatcacatttaattttcatgtgtatattatatgccctaaatatattatttctgctacttttaattcggttcctaaagcgatctagtgtgaaatggctacttcaaaggggaaactctattcatccccataaggggacgcccctcattttttatgtcacctaaaaatcatcaaaaaagttaaaacaattcagaaagataaatcaatatatgatatgtcacttcataaacatgcacgatcaaatccaacttatataagtagaaacaaaaataacaaatttaacaatgaatataacgtgtcattcatggttaaatttgttattttatttgtttcaaatcgtacaagtcgaattttagatctatcttgacattttttaaaaaaaattaatgattttttaaacaccatgcataaaataaggggatgtcctatcgaggaataaaaatccactttcactctaatgggtccttctaggacgttagaaggctgaaatttaactatttgtcaccctcataaacttcaactccccatttacattcttgcgcttatctttacaaatttactctacgagagatgttttcttaactactccctccgtcaaaaaaaaattgaacctaggagaggattcgttgtcatatatggcgtgtcagcgaggactaacaaatgttccatttatatatacctgagctctccagttcataaatatatatagctacctttgtaatttaatttattttgatatatagggaatgggaaagaacaaactagtgcaaatgtacagtagaatttactagtttattcccataccaacaagatgaataagtaaatcataaagacaaactaacaagatcgttaaaacttaaataaagtacaagatcagctattacttattagccaatcatatagtatatctgtatatatatgtatgtataaccatctatatgcatcatacaaccgagtacgtatgcatgtcaaagtgcatgcattacttctcacagcttcccgccaacgccgcctccgccaccgaaacctccaccacctccgcctccggcacctagccctccaccaccac

SEQ ID NO: 930 - DNA, 4664 bp, Oryza sativa; identical to SEQ ID NO: 227

SEQ ID NO: 931 - DNA, 8731 bp, Oryza sativa; identical to SEQ ID NO: 231

SEQ ID NO: 932 - protein, 338 aa, Oryza sativa
MAPSKQQQMLLKKVMAKKPKTKRLSGFGLKPSAAFSRPHVPSAAASLQPSRRVRVVFEDPDATDSDSDDDEDAGAASKKRYFELFIGKPASSTKQASPASTVAAYANIGKVGSTCYRGVRLRKWGKWAAEIRNPFTGHREWLGTFDTADAASAAYQSASRNFAEEKRRRGVASSASPASSATPTPTASSSSSTSAAPFAHPSPSSVLEATKPAPKPESPPLPEQAATPLLVEATNETAELPDDPEFYKDILRGLQLPDIDPMDFRAGLDALDISDVPAYMNGEQDVLFTEDMLLGDFAEEDDLDLDDIGDDFCEDFPEIPSGYDFGRGDMFRQVDFCV

SEQ ID NO: 933 - protein, 235 aa, Oryza sativa
MAPRAATVEKVAVAPPTGLGLGVGGGVGAGGPHYRGVRKRPWGRYAAEIRDPAKKSRVWLGTYDTAEEAARAYDAAAREFRGAKAKTNFPFASQSMVGCGGSPSSNSTVDTGGGGVQTPMRAMPLPPTLDLDLFHRAAAVTAVAGTGVRFPFRGYPVARPATHPYFFYEQAAAAAAAEAGYRMMKLAPPVTVAAVAQSDSDSSSVVDLAPSPPAVTANKAAAFDLDLNRPPPVEN

SEQ ID NO: 934 - protein, 225 aa, Oryza sativa
MDDSSFGSEPTTSSSGGEAPASPPSTASSSSDGAGGKKKRPRKDGHHPTYRGVRMRSWGKWVSEIREPRKKSRIWLGTFATAEMAARAHDVAALAIKGRAAHLNFPDLAHELPRPATAAPKDVQAAAALAAAADFPASSANAGASNNPDGSDDASAGSASPPPPPDAADDALFDLPDLLLDLRYGPPSSGLSCASSWEDEVGLISGAGAAAAGVFRLEEPLLWEY

SEQ ID NO: 935 - protein, 105 aa, Oryza sativa
MAEEKKHHHLFHHKKDGEEESSGVVDYDKEKKHHKHLEQLGGLGAIAAGAYALHEKHQAKKDTENAHGHKVKEEVAAVAALGAAGFAFHEHHEKKDAKKHAADQY

SEQ ID NO: 936 - protein, 105 aa, Oryza sativa; identical to SEQ ID NO: 935

SEQ ID NO: 937 - protein, 138 aa, Oryza sativa
MAEEKHHHHLFHHKKDDEPATGVDSYGEGVYTSETVTTEVVAGGQDEYERYKKEEKQHKHKQHLGEAGALAAGAFALYEKHEAKKDPENAHRHKITEEIAATAAVGAGGYAFHEHHEKKKDHKSAEESTGEKKHHLFG

SEQ ID NO: 938 - protein, 468 aa, Oryza sativa
MGWGAVVYGGGVVGASLVGLGWAGLWFLNRRLYKEYEERRALVQILFGLVFAFSCNLFQLVLFEILPVLSKHARFLNWHLDLFCLILLLVFVLPYYHCYLLLRNSGVRRERALLVAALFLLVFLYGFWRMGIHFPMPSPEKGFFTMPQLVSRIGVIGVSVMAVLSGFGAVNLPYSYLSLFIREIDEKDIKTLERQLMQSMETCIAKKKKIVLSKMEMERIQGSEEKLKARSFLKRIVGTVVRSVQEDQTEQDIKSLDAEVQALEELSKQLFLEIYELRQAKIAAAFSRTWRGHAQNLLGYALSVYCVYKMLKSLQSVVFKEAGSVDPVTMTITIFLRHFDIGIDVTLLSQYISLIFIGMLVVISVRGFLANVMKFFFAVSRVGSGSTTNVVLFLSEIMGMYFISSILLIRKSLANEYRVIITDVLGGDIQFDFYHRWFDAIFVASAFLSLLLISAQYTSRQTDKHPID

SEQ ID NO: 939 - protein, 1147 aa, Oryza sativa
MQLPLPPLLPSPMHFLLLLLHLLSFSSSTAASASSEVAFLTQWLNTTAARPPDWSPSASSPCKWSHVGCDAATGSVTSVTFQSVHLAAPLPPGICAALPSLASLVVSDANLTGGVPDDLHLCRRLAVLDLSGNSLSGPIPASLGNATAMASLALNSNQLSGPIPASLGNLAASLRDLLLFDNRLSGELPASLGELRLLESLRAGGNRDLGGEIPESFSRLSNLVVLGLADTKISGALPASLGRLQSLQTLSIYTTMLSGSIPAELAGCGNLTNVYLYENSLSGPLPPSLGALPRLQKLLLWQNSLTGPIPDTFGNLTSLVSLDLSINAISGAIPASLGRLPALQDLMLSDNNLTGTIPPALANATSLVQLQLDTNAISGLIPPELGRLAALQVVFAWQNQLEGSIPASLAGLANLQALDLSHNHLTGAIPPGIFLLRNLTKLLLLSNDLSGVIPPEIGKAASLVRLRLGGNRLAGTIPAAVAGMRSINFLDLGSNRLAGGVPAELGNCSQLQMLDLSNNTLTGALPESLAGVRGLQEIDVSHNQLTGGVPDAFGRLEALSRLVLSGNSLSGAIPAALGKCRNLELLDLSDNALSGRIPDELCAIDGLDIALNLSRNGLTGPIPARISALSKLSVLDLSYNALDGGLAPLAGLDNLVTLNVSNNNFTGYLPDTKLFRQLSTSCLAGNSGLCTKGGDVCFVSIDASGRPVMSADEEEVQRMHRLKLAIALLVTATVAMVLGMVGILRARGMGIVGGKGGHGGGSSDSESGGDLAWPWQFTPFQKLSFSVEQVVRNLVDANIIGKGCSGVVYRVGLDTGEVIAVKKLWPSTRNGADKDDVAGGGRVRDSFSAEVRTLGCIRHKNIVRFLGCCWNKTTRLLMYDYMANGSLGAVLHERRHGGHGGGGAQLEWDVRYRIVLGAAQGLAYLHHDCVPPIVHRDIKANNILIGLDFEAYIADFGLAKLVDDGDFGRSSNTVAGSYGYIAPEYGYMMKITEKSDVYSYGVVVLEVLTGKQPIDPTIPDGQHVVDWVRRRKGAADVLDPALRGRSDAEVDEMLQVMGVALLCVAPSPDDRPAMKDVAAMLNEIRLDRDDYANVDLLLKSGAAAASPPRAAAAATSTSSSTPPSSSSFSGSSAMIYNSSSKAKSPFD

SEQ ID NO: 940 - protein, 390 aa, Oryza sativa
MAVMLVPIPLLLLHQHHNHEHEHPSPVAPQPTMASYYTLLLALLCPLLLLLIKLCRAKTRDDELFDKLPSPPGRLPVIGHLHLIGSLPYVSFRELAIKHGPDLMLLRLGTVPTLVVSSARAAQAILRTNDHVFASRTYSAVTDILFYGSSDVAFSPYGEYWRQVKKIATTHLLTNKKVRSYSRARQQEVRLVMARINEAAVARTTVDLSELLNWFTNDIVCHAVSGKFFREEGQNQMFWELIQANSLLLGGFNLEDYFPNLARVTTVRRLLCAKAHNVNKRWDQLLDKLIDDHATKRSSSVLDLDNEESDFIDVLLSIQHEYGLTRDNVKAILVIMFEGGTDTAYIELEYAMAELIRKPQLMAKLQAEVRSVVPRGQEIVTEEQLGRMPY

SEQ ID NO: 941 - protein, 509 aa, Oryza sativa
MEVELPWGARCAAAAFFVSSLCVAALGVVLLLLRRWPWCGCHVCRAYLAGSWRREFANLGDWYADLLRRSPTGTVHVHVLGCTVTANPANVEYMLKTRFDNFPKGRPFAALLGDLLGDGIFNVDGDAWRHQRKMASLELGSVAVRSYAYKIVAQEVEARLMPVLANAADSGAVVDLQDVFRRFAFDTICKISFGLDPGCLDREMPVSELADAFDAASRLSAMRGAAASPLLWKMKRFLNVGSERELKKAIKLIDGLAAAMIRERRKLGVANSHDLLSRFMASSGDDARGAADDKFLRDIVVSFLLAGRDTVSSALTTLFMILSKNPDVAAAMRAEAGAAAGESAAVSYEHLKRLNYTHAVLYENMRLFPPVQFDSKFCAAADVLPDGTYVDGGARVMYHPYAMGRMPRIWGADCDAFRPERWLTGAGGAFVPESLFKYPVFQAGLRVCLGKELAITEMKAVSVAVVRAFDVEVVGENGRCGGGAAAAPRFVPGLTASISGGLPVKIRRV

SEQ ID NO: 942 - protein, 266 aa, Oryza sativa
MELESEQHGCEHYTRGCRIRAPCCGEVFGCRHCHNEAKNSLEIHLNDRHEIPRHEIKKVICSLCDKEQDVQQYCSGCGACMGKYFCEKCNFFDDDVSKNQYHCDGCGICRTGGVDKFFHCDKCGCCYSNVLRDSHHCVEGAMHHNCPVCFEYLFDSTKDISVLHCGHTIHLECLNVMRAHHHFACPVCSRSACDMSDAWKKLDEEVAATPMPEFYQKKMIWILCNDCGATSNVNFHVLAQKCPGCSSYNTRETRGCGRPAAARSTV

SEQ ID NO: 943 - protein, 238 aa, Oryza sativa
MCGIKQEMSGESSGSPCSSASAERQHQTVWTAPPKRPAGRTKFRETRHPVFRGVRRRGNAGRWVCEVRVPGRRGCRLWLGTFDTAEGAARAHDAAMLAINAGGGGGGGACCLNFADSAWLLAVPRSYRTLADVRHAVAEAVEDFFRRRLADDALSATSSSSTTPSTPRTDDDEESAATDGDESSSPASDLAFELDVLSDMGWDLYYASLAQGMLMEPPSAALGDDGDAILADVPLWSY

SEQ ID NO: 944 - protein, 218 aa, Oryza sativa
MEVEEAAYRTVWSEPPKRPAGRTKFRETRHPVYRGVRRRGGRPGAAGRWVCEVRVPGARGSRLWLGTFATAEAAARAHDAAALALRGRAACLNFADSAWRMPPVPASAALAGARGVRDAVAVAVEAFQRQSAAPSSPAETFANDGDEEEDNKDVLPVAAAEVFDAGAFELDDGFRFGGMDAGSYYASLAQGLLVEPPAAGAWWEDGELAGSDMPLWSY

SEQ ID NO: 945 - protein, 301 aa, Oryza sativa
MDSPSPMAAQAADLSLTLAPSGGGGGGGGGGGGGGSSSACIDGKDVRLFPCLFCNKKFLKSQALGGHQNAHKKERSIGWNPYFYMPPTPHPAGNAAAAAAAATPGGMSSVTTPSGSYGVVGGAAVGATAGVGGGGGVGGGLLPAHAYAGHGYAAVPTSFPIASHSSSVVGSGGLQYYAGTDCGAAAAGAAKTTTTAAAAATAVAGSESGVQVPRFATHQHHLLAVVSSGRAMLAAPDQPGAGRDDMIDMLNWRRGSHGPTASAAATTPSPASTTTTLTTFASADGSNNGEENEELDLNLSL

SEQ ID NO: 946 - protein, 405 aa, Oryza sativa
GAVAVRDAVVAPVARRGAARKTAETVAGMWREVQGCGDWEGMLEPAPHPVLRGEVARYGELVGACYKAFDLDPASRRYLNCKYGRERMLEEVGMGGAGYEVTRYIYAAADVSVPTMEPSTSGRGRWIGYVAVSTDEMSRRLGRRDVLVSFRGTVTPAEWMANLMSSLEAARLDPCDPRPDVKVESGFLSLYTSADKTCRFGGAGSCREQLLREVSRLVAAYSGGGEDVSVTLAGHSMGSALALLSAYDLAELGLNRAAPVTVFSFGGPRVGNAAFKARCDELGVKALRVTNVHDPITKLPGVFLNEATAGVLRPWRHSCYTHVGVELPLDFFKVGDLASVHDLATYISLLRGADKKQPAAAAADAGGVLAKVMDFVGRRRGGGALPWHDAAMIQMGGLVQTLGLI

SEQ ID NO: 947 - protein, 358 aa, Oryza sativa
MPAFADIAIDPPLADSYRALALLRRDRDGGIAPPAVQMVGSGGAVLERDLPMVDLERLTRGGAGERKACAGAMARAASEWGFFQLTNHGVGRELMEEMRREQARLFRLPFETKEKAGLLNGSYRWGNPTATSLRHLSWSEAFHVPLASISGADCDFGDLTSLRGVMQEVAEAMSRVANTVAAALAEELTGRGGGGASAAPWFPAGCDETTCFLRLNRYPACPFAADTFGLVPHTDSDFLTVLCQDQVGGLHLMKDSRWVAVRPRPDALVVNIGDLFQAWSNNRYKSVEHKVVANAKTDRLSVAYFLCPSYDSLVGTCGEPSPYRAFTFGEYRKKVQEDVRTTGKKIGLPNFFKHSSVQ

SEQ ID NO: 948 - protein, 452 aa, Oryza sativa
MSCSSEKAAGAVGGKAARACDSCLRRRARWYCAADDAFLCQGCDTSVHSANPLARRHERLRLRVSSPPPLTARASVEEEAAAAVGTTTTTTSKREGGVTPAWSKRKARTRRPQVKSVGQLLSRRLVVPEMAVESSDERKADEDGAHEELEGQLLYRVPVFDPSLAEFCSPPPIDDAAAASSSCFKEDAADGAVEDAKYPAAAASSPVQQLPDSFVNFEPTDAELREFAADMEALLGQGLDDSNELQDSFYMETLGLITPPVEESGRVKMELDGGVASNSRVSLPSCRAHPKPEDVESADVLDIDFNCTSPDEQKSSASNGAAADSQFFHRSLDLRLNYEAIIESWGNSPWTDGRPPHGQLDDFWPNDHHYSGLWAAGGGGHGAEVGMMTVRPRMDGPGREARVTRYREKRRTRLFSKKIRYEVRKLNAEKRPRMKGRFVKRPSAAAAPCAVT

SEQ ID NO: 949 - protein, 257 aa, Oryza sativa
MSMGPAAGEGCGLCGADGGGCCSRHRHDDDGFPFVFPPSACQGIGAPAPPVHEFQFFGNDGGGDDGESVAWLFDDYPPPSPVAAAAGMHHRQPPYDGVVAPPSLFRRNTGAGGLTFDVSLGERPDLDAGLGLGGGGGRHAEAAASATIMSYCGSTFTDAASSMPKEMVAAMADDGESLNPNTVVGAMVEREAKLMRYKEKRKKRCYEKQIRYASRKAYAEMRPRVRGRFAKEPDQEAVAPPSTYVDPSRLELGQWFR

SEQ ID NO: 950 - protein, 336 aa, Oryza sativa
MRMLSKACSLVASSLPRCSSSAAPTIRGQPSLLPSVRKEWLGKPLLYGIGTLLVMPLRTLHGVGRMFGAGRFLCNMTSVSSSLQIELVPCLQDNYAYILHDVDTGTVGVVDPSEATPIINALEKRNQNLTYILNTHHHYDHTGGNLELKAKYGAKVIGSAKDRDRIPGIDITLSEGDTWMFAGHQVLVMETPGHTSGHVCYHFPGSGAIFTGDTLFSLSCGKLFEGTPQQMYSSLQKIIALPDETRVYCGHEYTLSNSKFALSIEPGNKDLQEYAANAADLRKRNTPTVPTTIGREKQCNPFLRTSSPEIKNTLSIPDHFDDARVLEVVRRAKDNF

SEQ ID NO: 951 - protein, 336 aa, Oryza sativa; identical to SEQ ID NO: 950

SEQ ID NO: 952 - protein, 566 aa, Oryza sativa
MATAATLPSSSSSAAAAVQTISRVLSFPRRGGGGFLHLRRHPLAAAAAATRGRGPLLRLGPRRPFSASASAGDNGAAAGGDGGGCDYDYDLFTIGAGSGGMRASRVAASLYGARAAVCEMPFATVASDSLGGVGGTCVLRGCVPKKLLVYASKYSHEFEESHGFGWRYGTEPKHDWSTLMTNKNLELQRLVGVQTNMLKNSGVTIIEGRGKVVDPHTVSVDGKLYTAKNILIAVGGRPSMPDIPGIEHVIDSDAALDLPSRPEKIAIVGGGYIALEFAGIFNGLKSGVHVFIRQKKVLRGFDEEVRDFVADQMSLRGITFHTEETPQAVMKSDDGLLTLTTNKGSINGFSHVMFATGRKPNTKNLGLEEVGVKMDKHGAIVVDEFSRTSVDSIWAVGDVTNRVNLTPVALMEGGALARTIFGNEPTKPDYSAVPSAVFSQPPIGQVGLTEEKAIEKYGDVDVYTSNFRPLRATLSGLPDRVYMKVIVCANTNKVLGVHVCGEDAPEIIQGIAIAVKAGLMKQNFDATIGVHPTTAEELVTMRSPTRKVRRDAVDEAKMKDEATSQK

SEQ ID NO: 953 - protein, 428 aa, Oryza sativa
MAQAVVPAMQCQVGAVRARPAAAAAAAGGRVWGVRRTGRGTSGFRVMAVSTETTGVVTRMEQLLNMDTTPFTDKIIAEYIWVGGTGIDLRSKSRTISKPVEDPSELPKWNYDGSSTGQAPGEDSEVILYPQAIFKDPFRGGNNILVMCDTYTPAGEPIPTNKRNRAAQVFSDPKVVSQVPWFGIEQEYTLLQRDVNWPLGWPVGGYPGPQGPYYCAVGSDKSFGRDISDAHYKACLYAGINISGTNGEVMPGQWEYQVGPSVGIEAGDHIWISRYILERITEQAGVVLTLDPKPIQGDWNGAGCHTNYSTKSMREDGGFEVIKKAILNLSLRHDLHISAYGEGNERRLTGLHETASIDNFSWGVANRGCSIRVGRDTEAKGKGYLEDRRPASNMDPYVVTALLAETTILWEPTLEAEVLAAKKLALKV

SEQ ID NO: 954 - protein, 160 aa, Oryza sativa
MASTNSWTHEIESPVAAPRLFRAAVMDWHTLAPKIASHIVASAHPVDGDGSVGSVRQFNFTSAMPFSHMKERLEFLDVDKCECKSTLVEGGGIGKAIETATSHIKVEPAANGGSVVKVESTYKLLPGVEVKDEITKAKESLTGIFKTAEAYLIANPDAYN

SEQ ID NO: 955 - protein, 464 aa, Oryza sativa
MGRAPAKRKPSSPPPPPPPGRCHFWLPNKRRHCANTPLPTSQYCGNHLPDSASDAGAPFRRLVPCPVDPSHTVLEENLEAHVGKCPLKKQAAALAAQPFYSKGINSGGGEGGGGVTSAAKRALVHKLTKDELRALIEKIKLAHASAAMAMRDSFLVTDACDNWMRNQVDRKVPYQEKHVTQQASIIGNMEAFGLLQKGGEVAEENGVKNAPAVVEFGAGRGYLTQMLADCYGIRNVFLVERRSYKLKADRSLRQNEGVTLKRLRIDIEDLNLQGIEALSGLHYLAIGKHLCGPATDMTMMCCLHERYNQAHEKEYGKSNLCGLALATCCHHLCQWNHYANKTFLSGLGITEEDFHTMTWFSSWAVDGDHSSPDSSLEVEDSSVEDRCGKAEKSDVEVSGIDRLIRSIPAGERAALGFMCKDIIDTGRLLWLREKGLDADLVSYVPSNISPENHLLIAKCTSLSG

SEQ ID NO: 956 - protein, 842 aa, Oryza sativa
MEAFLKEFGDYYGYPDGPKNIQEIRDTEFKRLDKGVVYLDHAGSTLYSELQMEYIFKDFTSNVFGNPHSQSDISSATSDLIADARHQVLEYFNASPEDYSCLFTSGATAALKLVGETFPWTQDSNFLYTMENHNSVLGIREYALAQGASACAVDIEEAANQPGQLTNSGPSIKVKHRAVQMRNTSKLQKEESRGNAYNLFAFPSECNFSGLRFNLDLVKLMKENTETVLQGSPFSKSKRWMVLIDAAKGCATLPPDLSEYPADFVVLSFYKLFGYPTGLGALLVRNDAAKLLKKTYFSGGTVAASIADIDFVKRRERVEEFFEDGSASFLSIAAIRHGFKLLKSLTPSAIWMHTTSLSIYVKKKLQALRHGNGAAVCVLYGSENLELSSHKSGPTVTFNLKRPDGSWFGYLEVEKLASLSGIQLRTGCFCNPGACAKYLELSHSELRSNVEAGHICWDDNDVINGKPTGAVRVSFGYMSTFEDAKKFIDFIISSFASPPKKTGNGTVVSGRFPQLPSEDLESKESFPSHYLKSITVYPIKSCAGFSVIRWPLCRTGLLHDREWMVQGLTGEILTQKKVPEMSLIKTFIDLEEGLLSVESSRCEDKLHIRIKSDSYNPRNDEFDSHANMYALLLIMCCLTSAACNKFDFGCRLENRNEETRINRWFTNAIGRQCKLLRYSSSTSKDCLNRNKSPGLCRDLESNINFANEAQFLLISEESVADLNRRLEAKDEDYKRAHEKLNPHRFRPNLVISGGEPYGEDKWKTVKIGDNHFTSLGGCNRCQMINISNEAGLVKKSNEPLTTLASYRRVKGKILFGTLLRYEIDEKRQCWIGVGEEVNPDIE

SEQ ID NO: 957 - protein, 1046 aa, Oryza sativa
MQPPHSSCKTQSNRFPIPVLGLALVLLLNFTSPTSSCTKQEKSTLLNFLTGFSQDGGLSMSWKDGMDCCEWEGINCSQDKTVTEVSLPSRSLEGHISPSLGNLTGLLRLNLSYNLLSGAIPQELVSSRSLIVIDISFNRLNGGLDELPSSTPARPLQVLNISSNLFKGQFPSSTWKVMKNLVKLNVSNNSFSGHIPTNFCTNSPSFAVLELSYNQFSGGVPPELGNCSMLRVLKAGNNNLSGTLPDELFNATSLDCLSFPNNNLEGNIGSTPVVKLSNVVVLDLGGNNFSGMIPDTIGQLSRLQELHLDNNNLHGELPSALGNCKYLTTINLKSNSFSGDLGKVNFSTLPNLKTLDIDMNNFSGKVPESIYSCSNLIALRLSYNNFYGELSSEIGKLKYLSFLSLSNNSFTNITRALQILKSSTNLTTLFIAYNFMEEVIPQDETIDGFENLQALSVDHCSLSGRIPLWLSKLTNLKLLFLSNNQLTGPIPDWISSLNRLFYLDISNNSLAGEIPITLMDMPMIRTTQNKTYSEPSFFELPVYDGKFLQYRTRTAFPTLLNLSLNKFMGVIPPQIGQLKMLVVLDFSHNNLSGQIPQSVCSLTSLRVLDLSNNNLTGSIPGELNSLNFLSAFNVSNNDLEGPIPIGAQFSTFPNSSFDGNPKLCGSMLTHKCKSAEEASASKKQLNKRVILAIVFGVLFGGAAIVLLLAHFLFSLRDAIPKIENKSNTSGNLEAGSFTSDPEHLLVMIPRGSGEANKLTFTDLMEATDNFHKENIIACGGYGLVYKAELPSGSTLAIKKLNGEMCLMEREFAAEVEALSMAQHDNLVPLWGYCIQGNSRLLIYSYMENGSLDDWLHNRDDETSSFLDWPTRFKIARGASQGLSYIHDVCKPHIVHRDIKSSNILLDKEFKAYVADFGLSRLILPNKNHITTELVGTLGYIPPEYGQGWVATLRGDVYSFGVVLLELLTGRRPVSILSTSEELVPWVLEMKSKGNMLEVLDPTLQGTGNEEQMLKVLEVACKCVNCNPCMRPTITEVVSCLDSVGSD

SEQ ID NO: 958-959 - skipped (2 entries)

SEQ ID NO: 960 - protein, 182 aa, Oryza sativa
MAFYLGSMGGSPSSWGVAEVPVPSSRPWSKAEDKVFESALVAFPEHTHNRWALVASRLPGRSAHEVWEHYQVLVDDVDLIERGMVASPGCWDDDNNSAGHGRGSGGDERRRGVPWTEEEHRLFLEGLEKYGRGDWRNISRWSVKTRTPTQVASHAQKFFIRQANASSRGDSKRKSIHDITAP

SEQ ID NO: 961-962 - skipped (2 entries)

SEQ ID NO: 963 - protein, 231 aa, Oryza sativa
MALRTLASRKTLAAAALPLAAAAAARGVTTVALPDLPYDYGALEPAISGEIMRLHHQKHHATYVANYNKALEQLDAAVAKGDAPAIVHLQSAIKFNGGGHVNHSIFWNNLKPISEGGGDPPHAKLGWAIDEDFGSFEALVKKMSAEGAALQGSGWVWLALDKEAKKLSVETTANQDPLVTKGANLVPLLGIDVWEHAYYLQYKNVRPDYLSNIWKVMNWKYAGEVYENATA

SEQ ID NO: 964 - protein, 238 aa, Oryza sativa
MAAAAVADEVTEAMEQVEGEREEADAVADEAAEVMEQAEGEREEAIDAVAGEAGEVMKEVVEGEREEANAMADEADEAMEPEGEREEEADAVADEATEPMEQVEGEGEDGDAAAQRPALPLGRVKRIIRVDRDIKKVTNEAALLIAAATELFVGSLAAGAHRAASRRGRRAVRAVHVRAAAREHRPTADFLLDCLPAAEEAAPARAAAAGPSRGGGRGEAKPLPRGTRRIDAFFQKTT

SEQ ID NO: 965 - protein, 287 aa, Oryza sativa
MEATGAAVSAFSTASSSSPAAPRHGRLLASPAAWRSARTLPPRAVASSRATVLVSNPPPPPLPPTPAPAAVAPSKVDRSGRFCSPRAARELALMISYAACLEGADVVRLFDRRISARREPGYVFDKACVVNYNHMSFGGGPLEVGTEEEAEKLMSQNEKDSANEAEVLSAPPKLVYNNFVLRLAREILVAVASGWDKHVDIINKITPQNWKDEPVARILELCILHIAMAEMTSKGTPHKIVINEAVDLAKRFCDGGAPRVINGCLRTFVKDHMNIDTSQPAPAESKA

SEQ ID NO: 966 - skipped

SEQ ID NO: 967 - protein, 235 aa, Oryza sativa
MGDSQYSFSLTTFSPSGKLVQIEHALTAVGSGQTSLGIKAANGVVIATEKKLPSILVDETSVQKIQSLTPNIGVVYSGMGPDFRVLVRKSRKQAQQYYRLYKETIPVTQLVRETAAVMQEFTQSGGVRPFGVSLLIAGYDDNGPQLYQVDPSGSYFSWKASAMGKNVSNAKTFLEKRYTEDMELDDAIHTAILTLKEGYEGQISANNIEIGIIRSDREFKVLSPAEIKDFLEEVE

SEQ ID NO: 968 - protein, 316 aa, Oryza sativa
MAAAVAVAGPSMEVEQDLPGFRFHPTEEELLDFYLSRVVLGKKLHFNIIGTLNIYRHDPWDLPGMAKIGEREWYFFVPRDRKAGNGGRPNRTTERGFWKATGSDRAIRSSGDPKRVIGLKKTLVFYQGRAPRGTKTDWVMNEYRLPDYGAARAAAPPPKEDMVLCKIYRKATPLKELEQRASAMEEMQRGSSHGDYTATRASLVHDASASTGDDYFSSDDVHDSGFLIQSSSSSAAPSGSSSKNGGAGAPREAKKEEADVTVTVASATSLQLPAVSQLPSLQLPAMDWLQDPFLTQLRSPWQDQHCLSPYAHLLYY

SEQ ID NO: 969 - protein, 359 aa, Oryza sativa
MVETSTSLVKLEQDGSLFLPPGFRFHPTDAEVILSYLLQKFLNPSFTSLPIGEVDLNKCEPWDLPSKAKMGEKEWYFFSHKDMKYPTGMRTNRATKEGYWKATGKDREIFNLQPTSYGGSSNNKNNKQLVGMKKTLVFYMGRAPKGTKTNWVMHEFRLHANLHNDNPNLRLNLKDEWVVCKVFHKKGDDREAINKQQAQAAAVDQYSAGTPNNGSSVEAGDDDDDLFQLDSIIDPSIYFSNSSAANILSAPPNMSNSVVAANYGASTTTTGTASAGSFQQQPNYCSLINKSISSSNVSSWNNMPPPPPVAEGGVHGIGSSYSLQHQAAMVKALRDVIRLPNPLGMPQYKLDDAYLWDSS

SEQ ID NO: 970 - protein, 385 aa, Oryza sativa
MEERNDVNMDKSDEILLPGFRFHPTDEELVSFYLKRKIQQKPISIELIRQLDIYKFDPWDLPKLASTGEKEWYFYCPRDRKYRNSVRPNRVTTAGFWKATGTDRPIYSTEGTKCIGLKKSLVFYKGRAARGIKTDWMMHEFRLPTLTDPSLPKKPIDKNIPLNDSWTICRIFKKTSSMAQRALCQTWGAQLPGTIDPDIFSTLQSVQASQFALESSSCSLQAAATAAHQITSKYALQGNNNNQQQQQQHKPSNPLDGSSCKVINFNCSQSAEVQNSQIILPFEAHTSQKTATPLLFDTQFGQPDQISRFVVDSSVNANGGGISNKSQDPSARKPGSGFSMNSDWDGVARINFPFDLGADSSEDWRSSIPWESFLSPTTVHAEMPN

SEQ ID NO: 971 - protein, 292 aa, Oryza sativa
MEQQRSRSTAAGGEVEVEQLPGFRFHPTEEELLEFYLKQVVQGKKLKFDIIPTVHLYRHDPRELPGLARIGEREWYFFVPRDRKQATGGGGGGRPSRTTERGFWKATGSDRAIRCAADPKRLIGLKKTLVYYEGRAPRGTKTDWVMNEYRLPDAAAIPDTMQLQMQHDDMVLCKVYRKAVSLKELEQRVAMEELARSTTSSGTHNTGSPLQQDSSSISISSSSDAMKKEVVGVDEASAAAHELVRPATLSLPQLEVARPQSGLEWMQEPFLTQLRSPWMETWSPYYASVLNF

SEQ ID NO: 972 - protein, 336 aa, Oryza sativa
MYTYTAGADRSIEMEEEQRLPAGFRFFPTDEELVTYYLARKAMDATFTSAAIRDVDLYTSDPWHLPCDSSAASTGGGGGGECYFFCRRSSKYPSGARVRRATAGGYWKSTGKDKGVYAAGGGGGLVGTKKTLVFYEGRAPRGEKTSWVMHEYSRAPSTNFIRGAQSEWVICRVFKKQPPIEHWLEMEEVETTTTTTTVQEHTPNRRRLPPAEAAAAPPPPSGQPWQHTSRRSGDGRAAIDGGNREEEEDEHGLAREESSSPVVISSPSRCTSSPSSRLLNHEHLGASSSDDLPELMEFGDIYGGIAAGGPTDQQASSSNSNSICNFLDEPYYCWNF

SEQ ID NO: 973 - protein, 412 aa, Oryza sativa
MASLLGLLFSSLLFSERCEARRRARSGGEVAMDEAEAAAAAAKMDELAGGGGGGGGDWSYLAADALAAASFTAFPFHHHHHHHHRDVLSASTPSSLLLNMDAATAAAMFDFQAAFPSSSVPPPPPTTTAALPPFHDFASSNPFDDAPPPFLAPPGQKLGFLGPPGGAFGGGMGWDDDDEIEQSVDASSMGVSASLENAAPVAAGGGGGGGGGGGRGKKKGMPAKNLMAERRRRKKLNDRLYMLRSVVPKISKMDRASILGDAIEYLKELLQRINDLHNELESAPSSSLTGPSSASFHPSTPTLQTFPGRVKEELCPTSFPSPSGQQATVEVRMREGHAVNIHMFCARRPGILMSTLRALDSLGLGIEQAVISCFNGFAMDVFRAEQCRDGPGLGPEEIKTVLLHSAGLQNAM

SEQ ID NO: 974 - protein, 524 aa, Oryza sativa
MLPRFHGAMWMQDDGGGDQEHGQAAPPGQEQHHHDQHLMALAAAAAGGAGFGAAQAPAPLLDEDWYFDAAGGGGGGAHGSMMLGLSSVHGGIGAGTSGGGHGQQFSLLNMGAAAAPFDVSGFDLGIACGGVGGGGDVVSFLGGGNASNTALLPVGNAGFLGTFGGFGTAASQMPEFGGLAGFDMFDAGAVNTGGSSSSSSAAAAAASASAHVSNTAPFSGRGKAAVLRPLDIVPPVGAQPTLFQKRALRRNAGEDDDDKKRKAAAGAGAGALSADGADMVLDDGDDDGLSIDASGGLNYDSEDARGGEDSGAKKESNANSTVTGDGKGKKKGMPAKNLMAERRRRKKLNDRLYMLRSVVPKISKMDRASILGDAIEYLKELLQKINDLQNELESSPATSSLPPTPTSFHPLTPTLPTLPSRIKEEICPSALPSPTGQQPRVEVRLREGRAVNIHMFCARRPGLLLSAMRAVEGLGLDVQQAVISCFNGFTLDIFKAEQCKDGPGLLPEEIKAVLMQSAGFHTMI

SEQ ID NO: 975 - protein, 1503 aa, Oryza sativa
MAKARKQKGEEQKPDGGGAGGGGGGATVLHQKLCLSIDMENRLIYGYTEIKVQAENDTFALHADNMTIRNILVDGQAAEFEYSPQWKNAGDQQSWSSVSCSKTAADAACSVYISSLNSEAAPNLIISSERSSKAITEPQYEENGENHEENGEKHEENGEKQNENGEKCEENGGKPAQISDDQAVNGCNGSADKKDKEEETEKDNEKEKEDKEEETEKDNEKEKEDKEEETKKDNEKEKEQLMGTDEKEKEKEKEDENEEEKLEEEEKKDKEEKLEEKEKENEEENGNEKDKENDNEIEKVKNTKLVHIDYILEKAETGLYFTGNILHSNNQIRRAHCWFPCIDSATQRCPFDLEFTVSTNLVAVSNGDLLYQVLSKEDPPRKTYVYKLSTPVSAQWISLVVGPFEVLPDRNDISVSHMCLSQSLSKLENTISFFHSVYSCYEDYLAASFPFGLYKQVFLPPEMIVSPTSLGASTCIFNSDILHDEKVIDQIIDTRIKVAYALARQWFGIYTNAEEATDEWLLDGLAGFLTEHFVKRYLGNNEARYRRFKANCIVCEFDVSGATALSSPSASSDLFGTQTIGSYGKIRSLKAVSVLQMLEKQMGPDSFRKILQMIVAPTRASRTLSTKEFRHLANKVGNLERPFLKEFFPRWVESSGCPVMRLGISYSKRRNLVELAVSRGCTTKVDPGPDIRTNGDSREGDTGWPGMMSVRVHETDGVYDHPIVPMAGEALQVVEIQCHSKVAAKRFQKTKKGSKPDGSDENIDASNQDNRASMDAPLLWIRVDPEMEYLAEIHFHQPVQMWINQLEKDKDVISQSQAISVLEKSPQLTFAVTNALNNFLNDTKAFWRVRVEAAYALAVTASEGTELTGLLHLVKFYKSRRFDADIGLPRPNDFHDIPEYFVLEAIPHAVALVRSADKSSPKEAIEFILQLLKYNDNNGNVYSDVYWLSAMVQAIGELEFGQQGVGLLSSLLKRIDRLLQFDNFMPGYNGVLTVSCIRTLARIAQRVSSSICLDRVCELIVPYRNMDKPWKVRMEAGRVLIDLEFHHKGLDAALLLFLKYANEERSLRGGTKLAVHVLRLCQANIESHDNNQIQLPTLVGLLCLLAGKKAYNNVYLRHNVFCILQIAAGRSPTLHGVPKVVTPPQVVLEISSDQHTKADSSVPQQSRPQEPSTSTPSVREVLPTSGPLKDADNISNCSERRNVIFIPTKDADNISNCSERRNVISIPTKDADNISNCSERRNVVKIRVKRASSSSKADDADHRDHSHGRNENEAGPCSSMSVDAPMTEAPEPVNVSNHNIEEQNSCHDREQNSCHDRESRMSASIGNVKLMDKHEVSKELQCTADSRLDALPKDHFSPVVNGQEVLDKPRSQLEVVSTSYDGNQAPDSMNGLETKEKKKDKKDKKRHRDKKDDPEYLEKKRLKKEKKRMEKEKGKKQKEGEGVSSSEQKNTAKPSDSQGTSSARPPAPMRIPEPKISNVGTPVDTTRTLTTTKIRIKVKPLQR

SEQ ID NO: 976 - skipped

SEQ ID NO: 977 - protein, 500 aa, Oryza sativa
MAASFVIVIVISFFISLAFMCYVHYTSRQRRKLHGYGHEKAVRLPPGSMGWPYIGETLQLYSQDPNVFFASKQKRYGEIFKTHILGCPCVMLASPEAARFVLVTQAHLFKPTYPRSKERMIGPSALFFHQGDYHLRLRKLVQGPLGPDALRALVPDVEAAVRSTLASWDGNVSSTFHAMKRLSFDVGIVTIFGGRLDERRKAELRQNYAIVEKGYNSFPNSFPGTLYYKAIQARRRLHGVLSDIMRERRARGEPGSDLLGCLMQSRAGDDGALLTDEQVADNIIGVLFAAQDTTASVLTWIVKYLHDHPKLLEAVRAEQAAIRAANDGGRLPLTWAQTRSMALTHKVILESLRMASIISFTFREAVADVEYKGFLIPKGWKVMPLFRNIHHNPDYFQDPQKFDPSRFKVSPRPNTFMPFGNGVHACPGNELAKLEMLVLIHHLVTGYRWEIVGSSDEVEYSPFPVPKHGLLAKLWRDDSVSVETDGCQNGDNDDNGVAMV

SEQ ID NO: 978 - protein, 324 aa, Oryza sativa
MELPADGSALARQGSIYSLTFDEFQSALGSAEKDFGSMNMDELLRNIWTAEESQAIAPAAAAASAAAVVGDAQQQQQPIQRQGSLTLPRTLSQKTVDEVWRDIMGLGGSDDEDPAAAAAAAAPAQRQPTLGEMTLEEFLVRAGVVREDMGQTIVLPPQAQALFPGSNVVAPAMQLANGMLPGVVGVAPGAAAAMTVAAPATPVVLNGLGKVEGGDLSSLSPVPYPFDTALRVRKGPTVEKVVERRQRRMIKNRESAARSRARKQAYIMELEAEVAKLKEQKAELQKKQVEMIQKQNDEVMERITQQLGPKAKRFCLRRTLTGPC

SEQ ID NO: 979 - protein, 388 aa, Oryza sativa
MASEMSKNVKVTDDQEVTSQERDQSGGTKVGGEEEIAPLARQSSILSLTLEELQNSLCEPGRNFGSMNMDEFVANIWNAEEFQATTGGCKGAMEEAKVVDSGSGSGDAGGSGLCRQGSFSLPLPLCQKTVEEVWTEINQAPAHTSAPASALQPHAGSGGVAANDRQVTLGEMTLEDFLVKAGVVRGSFTGQAAMGSGMVNGPVNPMQQGQGGPMMFPVGPVNAMYPVMGDGMGYPGGYNGMAIVPPPPPAQGAMVVVSPGSSDGMSAMTHADMMNCIGNGMMIENGTRKRPHREDGCAEKTVERRQRRMIKNRESAARSRARKQAYTVELEAELNYLKQENARLKEAEKTVLLTKKQMLVEKMMEQSKEKMNANRGGSQLRRSGSCMW

SEQ ID NO: 980 - protein, 445 aa, Oryza sativa
MEDLALPAAPPAPTLSFTLLAAAAAVAEAMEEALGAALPPLTAPVPAPGDDSACGSPCSVASDCSSVASADFEGFAELGTSLLAGPAVLFDDLTAASVAVAEAAEPRAVGATARSVFAMDCVPLWGLESICGRRPEMEDDYAVVPRFFDLPLWMVAGDAAVDGLDRASFRLPAHFFAVYDGHGGVQVANYCRKRIHAVLTEELRRAEDDACGSDLSGLESKKLWEKAFVDCFSRVDAEVGGNAASGAPPVAPDTVGSTAVVAVVCSSHVIVANCGDSRAVLCRGKQPLPLSLDHKPNREDEYARIEALGGKVIQWNGYRVLGVLAMSRSIGDKYLKPYIIPVPEVTVVARAKDDDCLILASDGLWDVMSNEEVCDAARKRILLWHKKNAATASTSSAQISGDSSDPAAQAAADYLSKLALQKGSKDNITVVVIDLKAHRKFKSKA

SEQ ID NO: 981 - protein, 1088 aa, Oryza sativa
MESASSSLATSGRRRSSSGGGGGSWGSIGSAADPFDIPAKGAPVESLKKWRQAALVLNASRRFRYTLDLKREEQREEVISKIRAQAHVVRAAFRFKEAGQVHVQQKEVAAPPVDGALGFGIKEDQLTALTRDHNYSALQQYGGISGVARMLKTDTEKGISGDDSDLTARRNAFGSNTYPRKKGRSFLAFLWDACKDLTLIILMVAAAVSLALGITTEGIKEGWYDGASIAFAVLLVVVVTATSDYKQSLQFQNLNEEKQNIKLEVVRGGRRISVSIYDLVAGDVVPLKIGDQVPADGILISGHSLSVDESSMTGESKIVHKDQKSPFLMSGCKVADGYGTMLVTAVGINTEWGLLMASISEDSGEETPLQVRLNGVATFIGMVGLSVALAVLVVLLARYFTGHTYNPDGSVQYVKGKMGVGQTIRGIVGIFTVAVTIVVVAVPEGLPLAVTLTLAFSMRKMMRDKALVRRLSACETMGSATTICSDKTGTLTLNQMTVVEAYFGGKKMDPPDNVQVLSASISSLIVEGIAQNTSGSIFEPENGQDPEVTGSPTEKAILSWGLKLGMRFNDTRTKSSILHVFPFNSEKKRGGVAVHLGGSESEVHIHWKGAAEIILDSCKSWLAADGSKHSMTPEKISEFKKFIEDMAASSLRCVAFAYRTYEMVDVPSEDRRADWILPEDDLIMLGIVGIKDPCRPGVKDSVRLCAAAGIKVRMVTGDNLQTARAIALECGILSDPNVSEPVIIEGKAFRALSDLEREEAAEKISVMGRSSPNDKLLLVKALRKRGHVVAVTGDGTNDAPALHEADIGLSMGIQGTEVAKESSDIIILDDNFASVVRVVRWGRSVYANIQKFIQFQLTVNVAALIINVVAAVSSGNVPLNAVQLLWVNLIMDTLGALALATEPPTDHLMQRPPVGRREPLITNVMWRNLIIMALFQVIVLLTLNFRGTSLLQLKNDNQAHADKVKNTFIFNTFVLCQVFNEFNARKPDELNIFKGITGNHLFMAIVAITVVLQALIVEFLGKFTSTTRLTWQLWLVSIGLAFFSWPLAFVGKLIPVPERPLGDFFACCCPGSKQAADAKGDDADHSDV

SEQ ID NO: 982 - protein, 480 aa, Oryza sativa
MQRLASSRRLLQAALAPVRAQSSLSAAAAAAAPAPENAFAAAPKMPPFDYTPPPYDGPRAEEISRKRAEFLSPSLFHFYDRPLNIVDGKMQYLFDEDGRRYLDAFGGIATVCCGHCHPDVVEAMVNQAKRIQHSTVLYLNHAIADFAEALAAKMPGDLKVVFFTNSGTEANELALMIARLYTGCHDIISLRNGYHGNAAGTMGATAQCNWKFNVVQTGVHHALNPDPYRGAFGSDGEKYARDVQEIIDFGTTGRVGGFISEAIQGVGGIVELAPGYLPAVYNMVRKAGGLCIADEVQAGVARTGSHFWGFESHGVIPDIVTMAKGIGNGIPIGAVVTTPEIAQVLTRRSYFNTFGGNPVSTAGGHAVLKVLEKEKLQENAFVVGSYLKERLNKLKEKHDIIGDVRGKGFLLGVELVTDRQKKTPAKVEIGHVMNHMKDMGVLVGKGGFYGNVFRVTPPLCFTKEDSDFFIEAMDISLSKL

SEQ ID NO: 983 - protein, 314 aa, Oryza sativa
MATLTVPAAVPPVAEDCEQLRKAFKGWGTNEKLIISILAHRDAAQRRAIRRAYAEAYGEELLRALNDEIHGKFERAVIQWTLDPAERDAVLANEEARKWHPGGRALVEIACTRTPSQLFAAKQAYHERFKRSLEEDVAAHITGDYRKLLVPLVTVYRYDGPEVNTSLAHSEAKILHEKIHDKAYSDDEIIRILTTRSKAQLLATFNSYNDQFGHPITKDLKADPKDEFLGTLRAIIRCFTCPDRYFEKVIRLALGGMGTDENSLTRIITTRAEVDLKLIKEAYQKRNSVPLERAVAKDTTRDYEDILLALLGAE

SEQ ID NO: 984 - protein, 332 aa, Oryza sativa
MSSRMAGSAILRHVGGVRLFTASATSPAAAAAAAARPFLAGGEAVPGVWGLRLMSTSSVASTEAAAKAEAKKADAEKEVVVNSYWGIEQSKKLVREDGTEWKWSCFRPWETYTADTSIDLTKHHVPKTLLDKIAYWTVKSLRFPTDIFFQRRYGCRAMMLETVAAVPGMVGGMLLHLRSLRRFEQSGGWIRTLLEEAENERMHLMTFMEVANPKWYERALVITVQGVFFNAYFLGYLLSPKFAHRVVGYLEEEAIHSYTEFLKDLEAGKIDNVPAPAIAIDYWRLPANATLKDVVTVVRADEAHHRDVNHFASDIHYQGMELKQTPAPIGYH

SEQ ID NO: 985 - protein, 228 aa, Oryza sativa
MAASEQSSESSSTASTSSCGKKQQVAGKRKREDVGGGGEQAAAVAYRGVRMRAWGKWVSEIREPRKKSRIWLGTFPCPEMAARAHDVAALSIKGARAVLNFPDLAPALPRPASLAPRDVQAAAALAAVMHHHKHPSSSTSTSSPPAAPPPDEHHPRHEPQQPESSREDDQQQQPAAAAAAQMAVAELVFDELAPLWVEDVVEFGTSDHCWTAYDALDPIGFQPLLWEY

SEQ ID NO: 986 - protein, 250 aa, Oryza sativa
MAKNYPVVSAEYQEAVEKARQKLRALIAEKSCAPLMLRLAWHSAGTFDVSSKTGGPFGTMKTPAELSHAANAGLDIAVRMLEPIKEEIPTISYADFYQLAGVVAVEVSGGPAVPFHPGREDKPAPPPEGRLPDATKGSDHLRQVFGAQMGLSDQDIVALSGGHTLGRCHKERSGFEGPWTRNPLQFDNSYFTELLSGDKEGLLQLPSDKALLSDPAFRPLVEKYAADEKAFFEDYKEAHLKLSELGFADA

SEQ ID NO: 987 - protein, 251 aa, Oryza sativa
MGSKSYPTVSDEYLAAVGKAKRKLRGLIAEKNCAPLMLRLAWHSAGTFDVSSRTGGPFGTMKNPGEQSHAANAGLDIAVRLLDPIKDQLPILSYADFYQLAGVVAVEVTGGPEVPFHPGRQDKPEPPPEGRLPDATQGSDHLRQVFSAQMGLSDKDIVALSGGHTLGRCHKERSGFEGAWTSNPLIFDNSYFTELVSGEKEGLLQLPSDKALMADPAFRPLVEKYAADEDAFFADYAEAHLKLSELGFAEE

SEQ ID NO: 988 - protein, 324 aa, Oryza sativa; identical to SEQ ID NO: 978

SEQ ID NO: 989 - protein, 138 aa, Oryza sativa; identical to SEQ ID NO: 937

SEQ ID NO: 990 - protein, 437 aa, Oryza sativa
MGDHQMMHAAPAAMYNGGGGTTSSHGVWWSNAVGVPAAATCSTTTELAGYTAWSSALAAGYDGMVADNGGKQAKSTTTASSESPGNNSSVTFQEPASIPDPAAVAAVPQPGLAGFTDWTQPFMNNGAGLHEFLQDGHHDMSASSLMNHSSNNLALQQAGHHHELLSSFGSDLLLSPTSPYGGFQSSLLRSLMEPTAKQQQQQPALAGLQQYHQYQQQMGHAPAAAAKFAQAVGARDSLQFTNDAPFWNPSAGFGMPAAVAVAAAAAQDQASVRSAKRSSPAPPRAAATLALKTAMEGVGDSSSVITKKETAFKKPRLETPSPLPTFKVRKEKLGDRITALQQLVSPFGKTDTASVLHETIEYIKFLHDQVGALSAPYLKNGAHQVPHLKNSSPDKSKHGEISLKGRGLCLVPISSTFAVASEVPVELWTPFGANFIR

SEQ ID NO: 991 - protein, 299 aa, Oryza sativa
MQMESYYGAFHADEAAFFFPHHVPASPELPFGLIASPEPEPEPEQAAAEARQSAFQEYGGAVHAGAPAAAGAVTTGGTNIHRRVMDVLGRMGGGGGGGEKGEGEEMEEEEEVPQRRRRGQGADVESSRGFRHMMRERQRREKLSQSYADLYAMVSSRSKGDKNSIVQSAAIYIHELKVARDQLQRRNEELKAQIMGHDEQQPCVTVQFEVDEPSSSIDSMIAALRRLKGMSVKARGIRSSMSGNRLWTEMNVETTIAACEVEKAVEEALKEVERNQPDSDAPFPGSKGWTQTSHVQNVF

SEQ ID NO: 992 - protein, 170 aa, Oryza sativa
MQHDAISNIAYHPSMDFTSFFLPQTDAYSHDLSALLDMAVVDPYISCNGSSITMIPVTEDEANAQPMNHGNDERKKRRLVSNRESARRSRVRKQRRLDELSSQVSELRDTNQRLLVELNHMISKHARIVRENSQLREEASDLQRKLSEMKMEDAEVAAAAAAAPRTLEVA

SEQ ID NO: 993 - protein, 357 aa, Oryza sativa
MDFPGGSGRQQQLPPMTPLPLARQGSVYSLTFDEFQSTLGGVGKDFGSMNMDELLRSIWTAEESHAVGAATTTTATTASVAAAEHAAVGAPPVQRQGSLTLPRTLSQKTVDEVWRDMMCFGGGGASTAPAAAEPPPPAHRQQTLGEITLEEFLVRAGVVREDMSVPPVPPAPTPTAAAVPPPPPPQQQTPMLFGQSNVFPPMVPPLSLGNGLVSGAVGHGGGGAASLVSPVRPVSSNGFGKMEGGDLSSLSPSPVPYVFKGGLRGRKAPGIEKVVERRQRRMIKNRESAARSRQRKQAYMMELEAEVAKLKELNDELQKKQDEMLEQQKNEVLERMSRQVGPTAKRICLRRTLTGPW

SEQ ID NO: 994 - protein, 324 aa, Oryza sativa; identical to SEQ ID NO: 978

SEQ ID NO: 995 - protein, 153 aa, Oryza sativa
MSSGTSSGSSQGTRSSRSEDDLNLQAQMEKKRKRRKESNRESARRSRMRKQQHLDELTSQVNQLKNQNQQLSMALSLTTQNLVAVQAQNSVLQTQELELQSRLCALTDILMCMNNTSATPTPTIPATTTSACDIFGASSWNQPPIDLYQYQCF

SEQ ID NO: 996 - protein, 376 aa, Oryza sativa
MLTDRWGGRREAMEFGNGGSSSSERRAAAEGATLARQGSVYSLTFDEFQSALAGGGGGGGGGSGFGKDFGSMNMDELLRSIWTAEESQAMASASGSAAGVGVAVGAPPTSLQRQGSLTLPRTLSAKTVDEVWRNLVRDEPPPVGAADGGDMPPQRQSTLGEMTLEEFLVRAGVVRENPPAAPPPVPPPMPPRPVPVVPKTTAFLGNFPGANDAGAAALGFAPLGMGDPALGNGLMPRAVPVGLPGAAVAMQTAVNQFDSGDKGNSDLSSPTEPMPYSFEGLVRGRRNGGGVEKVVERRQRRMIKNRESAARSRARKQAYTLELEAEVQKLKEMNKELERKQADIMEMQKNEVEEMIKDPFGRRKRLCLRRTLTGPW

SEQ ID NO: 997 - protein, 272 aa, Oryza sativa
MSTAAAAAAAQSWCFATVTPRSRATVVASLASPSPSSSSSSSNSSNLPAPFRPRLIRNTPVFAAPVAPAAMDAAVDRLKDGFAKFKTEFYDKKPELFEPLKAGQAPKYMVFSCADSRVCPSVTMGLEPGEAFTVRNIANMVPAYCKIKHAGVGSAIEYAVCALKVELIVVIGHSRCGGIKALLSLKDGAPDSFHFVEDWVRTGFPAKKKVQTEHASLPFDDQCAILEKEAVNQSLENLKTYPFVKEGIANGTLKLVGGHYDFVSGNLDLWEP

SEQ ID NO: 998 - protein, 387 aa, Oryza sativa
MAPLSVSAILAPSPPPAQAAARASPRRAPASAAPVAAAISTALLALTPAAHAAAFSKEDVAGSVTKVVDTVDQVIGVGGKVAEQSAGVLKALGEAAKPALPALKSAGEQALKLASPVVSGASKQATEALQGAGVDPAPVLSAAKTVADAAQQGTKVIDAAKPIASATVETIGSLGSADYVVVAGAAFLAYLLLPPAWSLLSFTLRGYKGDLTAAQALDMVTSQDYVLIDVRTEKDKAKTGVPQLPSNAKNKLISIPLEELPSKTKSMVRNAKQAEAEIAALKISYLKRIGKGSNVIIMDSYCDSSKIVAKTLNSVGFKNCWVMAGGFSGRKGWAQSRLGTDSYNLSVVEVVTPSRVIPAAADRLVTASSSASRTTTSRKLLPGSVDG

SEQ ID NO: 999 - protein, 213 aa, Oryza sativa
MGCVSSKQFKRAAQHEDPAILAKETTFSVSEVEALFELFKKISHSIFRDGLIHKEEFQLALFRNSNKKNLFANRIFDLFDLKRNGVIDFGEFVRSLSIFHPETPLGDKIAFAFRLYDLRGTGCIEREELHEMVLALLNESDLFLSEEAVEQIVDQTFKQADLNDDGKIDPDEWKTFASKNPALLKNMTLPYLKDITMVFPSFILNSEVCEEEL

SEQ ID NO: 1000 - protein, 205 aa, Oryza sativa
MQRAIQAIGSHGSLLKSAVLRHISAPKPSILPAVYSRSMSVSSAQIEESGFETATVADILKSKGKSADGSWLWCTTDDSVYDAVKSMTQHNVGALVVVKPGQDKSIAGIVTERDYLRKIIVQGRSSKSTKVGDIMTEENQLITVKPDTRVLQAMQLMTEKRIRHIPVIDGTGMVGMVSIGDIVRAVVSEHREELNRLNAYIQGGY

SEQ ID NO: 1001 - protein, 542 aa, Oryza sativa
MGNQCQNGTLGSDYHNRFPREHAVGYVQGDSYLDLKKFDDTWPEVNNFKPTAASILRRGLDPTSINVLGRKTADLREHYIIGRKLGQGQFGTTYLCTEINTGCEYACKTIPKRKLITKEDVEDVRREIQIMHHLSGHKNVVAIKDVYEDGQAVHIVMELCAGGELFDRIQEKGHYSERKAAELIRIIVSIVAMCHSLGVMHRDLKPENFLLLDKDDDLSIKAIDFGLSVFFKPGQVFTELVGSPYYVAPEVLHKRYGPESDVWSAGVILYVLLSGVPPFWAETQQGIFDAVLKGHIDFQSDPWPKISDSAKDLIRKMLSHCPSERLKAHEVLRHPWICENGVATDQALDPSVISRLKQFSAMNKLKKLALRVIAERLSEEEIAGLREMFKAVDTKNRGVITFGELREGLRRFGAEFKDTEIGDIMEAAHNDNNVTIHYEEFIAATLPLNKIEREEHLLAAFTYFDKDGSGYITVDKLQRACGEHNMEDSLLEEIISEVDQNNDGQIDYAEFVAMMQGSNVGLGWQTMESSLNVALRDAPQVH

SEQ ID NO: 1002 - protein, 551 aa, Oryza sativa
MGNACGGSLRSKYLSFKQTASQRHDTDDNNNAAAADSPKKPSRPPAAAKTDDHPVSASAPAAAMRRGQAPADLGSVLGHPTPNLRDLYAMGRKLGQGQFGTTYLCTELSTGVDYACKSISKRKLITKEDIEDVRREIQIMHHLSGHKNVVAIKGAYEDQLYVHIVMELCAGGELFDRIIQRGHYSERKAAELTRIIVGVVEACHSLGVMHRDLKPENFLLANKDDDLSLKAIDFGLSVFFKPGQTFTDVVGSPYYVAPEVLLKHYGPEADVWTAGVILYILLSGVPPFWAETQQGIFDAVLKGFIDFDSDPWPVISESAKDLITKMLNPRPKERLTAHEVLCHPWIRDHGVAPDRPLDPAVLSRIKQFSAMNKLKKMALRVIAESLSEEEIAGLKEMFQTMDADNSGAITYDELKEGLRKYGSTLKDTEIRDLMDAADIDNSGTIDYIEFIAATLHLNKLEREEHLVAAFSYFDKDGSGYITVDELQQACKEHNMPDAFLDDVINEADQDNDGRIDYGEFVAMMTKGNMGVGRRTMRNSLNISMRDAPGAL

SEQ ID NO: 1003 - protein, 292 aa, Oryza sativa
MALLSPPSPPPPLPPLRRRPASPTLLAVATRPSSLLSLPHCHCGLPLPSTANARAYSRSSRRRRRVAASLGQDEPGVSDTAVAPEGEGDSEPPASSDGAAGDIAASAEQPEASPEDLEDIRQVKRVLELLQKNRDMTFGEVKLTIMIEDPRDIERKRLLGIEDPDEITRDDLADALVEVNEGRIPENRVALQLLAKEMTEWPDLEMEAPKKKSKPGKSVYAKATDTGIDPETAAKRLNIDWDSAADLDDEEEEDDETEVPSAVGYSALYLLTAFPVIIGISVVLILFYNSLQ

SEQ ID NO: 1004 - protein, 567 aa, Oryza sativa
MASSSSSRLLFLLSCSVLALLAGAEVHHHEFIVQETPVKRLCKTHNVITVNGQLPGPTLEVREGDTVVINVVNHAQYNVTIHWHGIRQFRTGWADGPEFVTQCPIKPGGSYKYRFTIEGQEGTLWWHAHSSWLRATVYGALIIRPRENKTYPFEKPAREVPLILGEWWDADPIQVIREAQRTGAAPNISDAYTINGQPGDLYNCSKEETTAVPVKPGETALLRFINAALNQELFVSIAQHKMTVVGVDASYTKPFTTSVLMIAPGQTTDVLVTMDQAPTRYYLAARAYDSAQGVAFDNTTTTAVIEYDCGCATDFGPSIPPAFPVLPAFNDTNTATAFAAGIRSPHEVKIPGPVDENLFFTVGVGLFNCEPGQQCGGPNNTRFTASMNNISFVFPQTTSLLHAHYYGIPGVFTTDFPAYPPVQFDYTAQNVPRYLWQPVPATKLYKLKFGSVVQIVLQDTSIVSPENHPIHIHGYDFYILAEGFGNFDPKKDAKKFNYVDPPQRNTVAVPTNGWAVIRFVADNPGVWLMHCHLDVHITWGLAMAFLVEDGYGKLETLEAPPVDLPMC

SEQ ID NO: 1005 - protein, 449 aa, Oryza sativa
MYRAKRAALSPKVKRRVGKYELGRTIGEGTFAKVRFAKNTENDEPVAIKILDKEKVQKHRLVEQIRREICTMKLVKHPNVVRLFEVMGSKARIFIVLEYVTGGELFEIIATNGRLKEEEARKYFQQLINAVDYCHSRGVYHRDLKLENLLLDASGNLKVSDFGLSALTEQVKADGLLHTTCGTPNYVAPEVIEDRGYDGAAADIWSCGVILYVLLAGFLPFEDDNIIALYKKISEAQFTCPSWFSTGAKKLITRILDPNPTTRITISQILEDPWFKKGYKPPVFDEKYETSFDDVDAAFGDSEDRHVKEETEDQPTSMNAFELISLNQALNLDNLFEAKKEYKRETRFTSQCPPKEIITKIEEAAKPLGFDIQKKNYKMRMENLKAGRKGNLNVATEVFQVAPSLHVVELKKAKGDTLEFQKFYRTLSTQLKDVVWKCDGEVEGNGAAA

SEQ ID NO: 1006 - protein, 540 aa, Oryza sativa
MLMATVSPARREPTPQAVRASPMPSAAAALVRRGGGGSGGTVLGKYELGRVLGQGSFAKVYQARHLETDECVAIKVLDKEKAVKGGMVHLVKREINVLRRVRHPNIVQLFEVMASKTKIYFVMEYVRGGELFSRVSKGRLREDTARRYFQQLVSAVDFCHARGVFHRDLKPENLLVDENGDLKVSDFGLAAGPDQFDPDGLLHTFCGTPAYVAPEVLRRRGYDGAKADIWSCGVILFALMAGYLPFHDHNIMVLYRKIYNGEFRCPRWFSKDFTRLITRLLDANPKTRITVPEIIESDWFKKGYKPVKFYIEDDKLYNLSDDVLNLEPADPVPPPLGLAPPVPPPPQGDDPDGSGSESDSSVVSCPATLSTGESQRVRGSLPRPASLNAFDIISFSKGFNLSGLFEERGNEIRFVSGEPMSDIVKKLEEIAKVKSFTVRRKDWRVSIEGTREGVKGPLTIGAEIFELTPSLVVVEVKRKAGDNEEYEDFCNMELKPGMQHLVHQMLPAPNGTPVSEKVERSSSLQAPLTLKLIGTEGSMS

SEQ ID NO: 1007 - protein, 434 aa, Oryza sativa
MESRGKILMERYELGRLLGKGTFGKVHYARNLESNQSVAIKMMDKQQILKVGLSEQIRREITTMRLVAHKNIVQLHEVMATRNKIYFVMEYVKGGELFEKVAKRGKLTEVVAHKYFQQLISAVDYCHSRGVYHRDLKPENLLLDENENLKVSDFGLSALSESKRQDGLLHTTCGTPAYVAPEVISKIGYDGAKSDIWSCGVILFVLVAGYLPFQGPNLMEMYRKIQHGEFRCPGWFSRKLQKLLYKIMDPNPSTRISIQKIKESTWFRKGPEENRILKERTLNENTTKNVAPVLGVRRKKNAHEDVKPMSVTNLNAFEIISFSKGFDLSGMFIVKEWRNEARFTSDKSASTIISKLEDVAKALNLRVRKKDNGVVKMQGRKEGRNGVLQFDIEIFEVTTSYHIIEMKQTSGDSLEYRQLLEEGIRPALKDIVLA

SEQ ID NO: 1008 - protein, 565 aa, Oryza sativa
MKQEQVRMAVLLMLNCFVKATAPPPWPPSASSASFLDDLGDLGIAPLIRADEAGTARASADFGNLSVAGVGAPRLAAAAAVLYPSRPADIAALLRASCARPAPFAVSARGCGHSVHGQASAPDGVVVDMASLGRLQGGGARRLAVSVEGRYVDAGGEQLWVDVLRASMAHGLTPVSWTDYLHLTVGGTLSNAGISGQAFRHGPQISNVLELDVITGVGEMVTCSKEKAPDLFDAVLGGLGQFGVITRARIPLAPAPARARWVRFVYTTAAAMTADQERLIAVDRAGGAGAVGGLMDYVEGSVHLNQGLVETWRTQPQPPSPSSSSSSSFFSDADEARVAALAKEAGGVLYFLEGAIYFGGAAGPSAADVDKRMDVLRRELRHERGFVFAQDVAYAGFLDRVHDGELKLRAAGLWDVPHPWLNLFLPRSGVLAFADGVFHGILSRTPAMGPVLIYPMNRNKWDSNMSAVITDDDGDEVFYTVGILRSAAAAGDVGRLEEQNDEILGFCEVAGIAYKQYLPYYGSQAEWQKRHFGANLWPRFVQRKSKYDPKAILSRGQGIFTSPLA

SEQ ID NO: 1009 - protein, 938 aa, Oryza sativa
MEVCCCSTSSAVPGRRFAAAGAAAAAVAARWGAVGVGRAVVLAHPLRPAPRGGHAHAQQAGARRARRAVVRAVFERFTERAVKAVVLSQREAKGLGEGAVAPRHLLLGLIAEDRSAGGFLSSGINIERAREECRGIGARDLTPGAPSPSGSGLEMDIPFSGSCKRVFEVAVEFSRNMGCSFISPEHLALALFTLDDPTTNSLLRSLGADPSQLASVALTRLQAELAKDCREPAGASSFKVPKKSPAGAGRSAFSKSLNSKKEKGALDQFCLDLTTQASGGFIDPIIGREEEIERVVQIICRRTKNNPILLGEAGVGKTAIAEGLALRIANGDVPIYLVAKRIMSLDVGLLIAGAKERGELESRVTSLIREVREAGDVILFIDEVHNLIGSGTVGKGKGAGLDIGNLLKPPLARGELQCIAATTLDEHRMHFEKDKALARRFQPVLVEEPSQDDAVKILLGLREKYETYHKCKFTLEAINAAVYLSARYIPDRQLPDKAIDLIDEAGSRARMESFNRKKEGQSSILLKSPDEYWQEIRAAQNMHEVVSSNQMKYSPRQENGSAAIKAPSEDMNELTSELQVEEPIVVGTEEIARVASLWSGIPVQQLTADDRKLLVGLDGELRKRVIGQDDAVMAISRAVKRSRVGLNDPDRPIATLLFCGPTGVGKTELTKALAASYFGSESAMLRLDMSEYMERHTVSKLIGSPPGYIGYGETGTLTEAVRRKPFTVVLLDEIEKAHPDIFNILLQIFEDGHLSDSQGRRVSFKNTLIVMTSNIGSTSISKGRRSMGFMTEDTESSSYVAMKSLVMEELKAFFRPELLNRIDEMVVFRPLEKTQMLAILDIILQEVKGRLLALGIGLEVSDAMKDLICEEGYDKSYGARPLRRAVTHLIEDVISEAILFGEYKPGDTILMDIDAGGKLCMSHLNEKVVQLSDPTRTF

SEQ ID NO: 1010 - protein, 537 aa, Oryza sativa
MVGGRALLPLLLLSALLVQIRASDPLFYEPFDESFEGRWVLSGKDDYKGVWKHEKSDGHEDYGLLVSEKAKKYAIIKELDEPVTLKDGTVVLQFEVRLQNGLECGGAYLKYIRPQDAAWDAKEFDNETPYTIMFGPDKCGSTNKVHFILKHKNPKTGKYVEHHLKFPPSVPYDKLSHVYTAILKPDNEVRILVDGEEKKKANFLSADDFEPSLIPSKTIPDPDDKKPEDWDERAKIPDPDAVKPDDWDEDAPMEIEDEEATKPEGWLDDEPEEIDDPEANKPEDWDDEEDGEWEAPKIDNPKCEEAPGCGEWKRPMKQNPAYKGKWHAPLIDNPNYKGIWKPQEIPNPEYFELDKPDSDPIAAIGIEIWTMQDGILFDNILIADDEKVATSILEKSWKPKYEVEKEKEKAEEAAAAAGDGLSEFQKKIFDVLYKLADIPFLEPYKTKIIDVIEKGEKQPNITIGILVSIVVVFVTVLFRILFGGKKPAAPVKPVAEVKKPKSTESEAAGSSGGKEDEKEEEEKDGAAAPRRRSRRET

SEQ ID NO: 1011 - protein, 514 aa, Oryza sativa
MKKKKKKKKRRMAAAMAADPCLPLRPCPSFLDDEQRKRNGVEVGGSGGVVGWGLPPLMQMGYRPNILHYGLLWAYSSIRLRCGASRLPPPPVFVVVACGWQINRIDPLSSARGHRISPLPLGAQVLAAARPFLLFSSYVNNPPTIDTTNPIMSSLCPFAKLASAGATCPVKSSSDNKTTINHTDDDDDDNEKTGNANTDPRVVPPKCPFGYDSNTFKLGPLSCMVCHALLHQSSKCTPCSHKFCKACILRFKDCPLCGADIQGIEPDDELQGLVDRFIDGHARIKRSHAAGDGEAASDNKTKVIYEDVSMERGAFLVQQAMRAFRAQNIESAKSRLSMCAQDIREELKSKQDNQELCSQLGAVLGMLGDCCRTLGDAPSAITYYEESAEFLSKLPKKDLELVHTLSVSLNKIGDLRYYDGDLHSARSYYARSLDVRRSAAKEHSAVASQVIDVATSLAKVADVDRNLGNESMAVEGFEEAIKCLENLKLESGEASLEQRRLSVLDFLQKQLDDK

SEQ ID NO: 1012 - protein, 565 aa, Oryza sativa
MGGCYSAYASSRKLRGRISKISLVIPDPVPDAEAASPRKDGVDGDGDDVRGGGGGCDDGGDVVAIATTTADEFARRYVLGKELGRGEFGVTRRCSDAATGEALACKTIRKHRRLAPPRVTAAKAAAAHGEDVKREVAIMRRMSSASSSRGGGAASSAAVVRLREACEDAADGSVHLVMELCEGGELFDRIVARGHYSERAAANIFRTIVDVVQLCHSNGVIHRDLKPENFLFANKSEDSPLKVIDFGLSVFFKPGDRFTEVVGSAYYMAPEVLRRSYGPEVDVWSAGVILYILLCGVPPFWGDNDEKIAQAILRGAIDFNREPLPRVSANAKDLVRRMLDPNPSTRLTAKQVLEHPWLKNADTAPNVSLGDAVRARLQQFSAMNKFKKKALGVVARNLPGEEVDKYVQMFHHMDKDKNGHLSLDELLEGLHINGQPVPEPEIRMLLEAADTDGNGTLDCDEFVTVSVHLKKMSNDEYLAAAFNYFDKDGSGFIELDELREEVGPNEQAILEILRDVDTDKDGRISYQEFELMMKSGADWRNASRHFSRANFSTLSRRLCKDTLTP

SEQ ID NO: 1013 - protein, 522 aa, Oryza sativa
MGACFSSHTATAAADGGSGKRQQRKGDHKGKLPDGGGGEKEKEAARVEFGYERDFEGRYQVGRLLGHGQFGYTFAATDRASGDRVAVKRIDKAKMVRPVAVEDVKREVKILKELKGHENIVHFYNAFEDDSYVYIVMELCEGGELLDRILAKKNSRYSEKDAAVVVRQMLKVAAECHLHGLVHRDMKPENFLFKSTKEDSPLKATDFGLSDFIKPGKKFHDIVGSAYYVAPEVLKRRSGPESDVWSIGVITYILLCGRRPFWNKTEDGIFREVLRNKPDFRKKPWPGISSGAKDFVKKLLVKNPRARLTAAQALSHPWVREGGEASEIPVDISVLSNMRQFVKYSRFKQFALRALASTLKEEELADLKDQFDAIDVDKSGSISIEEMRHALAKDLPWRLKGPRVLEIIQAIDSNTDGLVDFEEFVAATLHIHQMAELDSERWGLRCQAAFSKFDLDGDGYITPDELRMVQHTGLKGSIEPLLEEADIDKDGRISLSEFRKLLRTASMSNLPSPRGPPNPQPL

SEQ ID NO: 1014 - protein, 574 aa, Oryza sativa
MGNTCCVAPATTDEVGAPPRDHHHAAKKSPAPSATTTTATRQRHGQEPKPKPKPRARAKPNPYDWAPPRVLPARGGAAASAVRVLEGVVPHHPRLRVTDKYQLGRELGRGEFGVTHLATDRATRERLACKSIPKRRLRTAVDVADVRREVAIMASLPDHPALVRLRAAYEDADAVHLVMELCDGGELFDRIVARGRYTERAAAAAARTVAEVVRACHAHGVMHRDLKPENFLYAGKAEDAQLKAIDFGLSVFFRPGERFREIVGSPYYMAPEVLRRDYGPEVDIWSAGVILYILLCGVPPFWAETEQGVARAILRGAADFDREPWPRISRAAKSLVRQMLDVDPRRRPTAQQVLDHPWLHHAARAPNVPLGDVVRARLKQFSLMNRLKKKAMRVIAEHLSVEEVEVIKDMFALMDTDNNGRVTLQELKDGLTKVGSKLAEPEMELLMEAADVDGNGYLDYGEFVAVTIHLQRLSNDNHLRTAFLFFDKDGSGYIDRAELADALADDSGHADDAVLDHILREVDTDKDGRISYEEFVAMMKSGTDWRKASRQYSRERFKTLSNSLIKDGSITMAR

SEQ ID NO: 1015 - protein, 115 aa, Oryza sativa
MSYLLSYISKMLCIKIPSEARQASEDGGSGGLTECSVCLSRIRVGEATRRLPCRHAFHRDCVDRWLLSCRRTCPLCRVYVVVDGNKPGVAAKHTGEPPLAEDMVIWFSAMLVPGF

SEQ ID NO: 1016 - protein, 164 aa, Oryza sativa
MWGSADGGTPEVTLETSMGAFTIEMYYKHAPKTCRNFLELSRRGYYDNVIFHRIIKDFIVQGGDPTGTGRGGESIYGAKFEDEIRPELKHTGAGILSMANAGPNTNGSQFFITLAPCQSLDGKHTIFGRVSKGMEIVKRLGSVQTDKSDRPIHEVKILRTVVKD

SEQ ID NO: 1017 - protein, 208 aa, Oryza sativa
MAARETSRHASLCLWLALVAATLSLAQAVESEAELTKVTTKVFFDITINGKPAGRIVMGLFGNTVPKTAENFRAICTGEKGLGKSGKPLSYKGTPFHRIIPGFMIQGGDTVSGNGTGCDSIYGGMFPDENFKINHSAPGLLSMANYAKDTNGSQFFITTVKLTRLDGKHVVFGKVLSGMDVVYKIEAEGSQSGTPRSKVLISDSGELK

SEQ ID NO: 1018 - protein, 172 aa, Oryza sativa
MSNTRVFFDMTVGGAPAGRIVMELYAKDVPRTAENFRALCTGEKGVGKSGKPLHYKGSTFHRVIPEFMCQGGDFTRGNGTGGESIYGEKFADEVFKFKHDSPGILSMANAGPNTNGSQFFICTVPCSWLDGKHVVFGRVVEGMDVVKAIEKVGSRGGSTAKPVVIADCGQLS

SEQ ID NO: 1019 - protein, 235 aa, Oryza sativa
MARIKPKQLLIQSKTKKAPTRISYSTIVTWNLIVILVALSLYATYRHWHHRPMLETEMDLPRAEHVGRSEDSTKTSRPSYAVIDTAKGSITIEIYKDASADVVDRFVSLCKSNHFKGMPFRHVIKNFVIQGGDFDFNGAAQEWILKAKASGENALSPKHEAFMIGTTKNPNNKGFDLFITTAPIPDLNDKLVVFGQVINGQDIVQEIEEVDTDEHYQPKTPIGILNITLKQQALS

SEQ ID NO: 1020 - protein, 243 aa, Oryza sativa
MDHIGISGGGEGGVVSPAQPSSPERRYKGVRLRKWGRWVSEIRMPNSRERIWLGSYESAEKAARAFDAAAVCLRGSRGAGSLNFPESPPPDVRRRFPGAALTVEQIQAEAARHANRPFPANTAAAGGSSSSYSISQRQEAAAPARSTSNDDTAMSSVPSTDGGAADYDGGDDVIDWSFMDTLPAMSSSAASTNADLVPAMDDFMYGFLHTMPPSPCEDGGEDVMIDGNCNMDQTFFSVDLWRF

SEQ ID NO: 1021 - protein, 414 aa, Oryza sativa
MESLTLRASPSTAAPLRRVPGRRHAAVSVRASAGAGEPDLSVRVNGLKMPNPFVIGSGPPGTNYTVMKRAFDEGWGGVIAKTVSLDAEKVINVTPRYARLRADPNGSTKSPIIGWQNIELISDRPLETMLNEFKQLKKEYPDRILIGSIMEEYNKAAWHELIERVEESGVDALEINFSCPHGMPERKMGAAVGQDCDLLEEVCGWINEKATVPVWAKMTPNITDITKPARISLKSGCEGVSAINTIMSVMGINLKTLRPEPCVEGYSTPGGYSARAVHPIALAKVMQIARMMKEEFADGQSLSAIGGVETGNDAAEFILLGADTVQVCTGVMMHGYGLVKKLCAELQDFMRQHNFSSIEDFRGASLPYFTTHTDLVHRQREAINQRKAIRKGLESDKDWTGDGFVKETESMVSN

SEQ ID NO: 1022 - protein, 245 aa, Oryza sativa
MDSDHWISRLMAAKRQYALQRAQNHHHATATATATAASHSHLDRYGYDDVEPEDEVRPDFPCPYCYEDHDITSLCAHLEDEHPFESKVVACPVCSARISKDLLDHITLQHSYLFRLQRHHRLRRVAVPSNHALSLGGRDLQETYLKVLLGNSSRSSGTNAASSVTDSLLSSLVLNLSSSEAEDTAKFSALAVVENNWFKRTLPSKTWKASSDSNLSQEERERRRRRAAVRSSFVQHLLVSTLFDD

SEQ ID NO: 1023 - protein, 109 aa, Oryza sativa
MSQLKSSSLAALLIFLLAVFTTAAAAAGTECQNDVEVLKTTCYKFVEKDGPKLQPSPDCCTSMKGVNVPCVCTYLGSPGVRDNINMDKVFYVTKQCGIAIPGNCGGSKV

SEQ ID NO: 1024 - protein, 325 aa, Oryza sativa
MQYEDLAGQNFRCTSGPLTISSVFMASVTYIDDSGSEVIDPPKTEVLDVTELAGDPVPHSPKPNVVVSSSVRELLECPVCLSAMYPPIHQCSNGHTLCSGCKPRVHNRCPTCRHELGNIRCLALEKVAASLELPCKYQNFGCVGIYPYYCKLKHESQCQYRPYSCPYAGSECTVAGDIPYLVNHLKDDHKVDMHNGCTFNHRYVKSNPHEVENATWMLTVFSCFGQYFCLHFEAFQLGMAPVYIAFLRFMGDDLEAKNYSYSLEVGGTGRKMIWQGVPRSIRDSHRKVRDSYDGLIIQRNMALFFSGGERKELKLRVTGRIWKEQ

SEQ ID NO: 1025 - protein, 238 aa, Oryza sativa; identical to SEQ ID NO: 943

SEQ ID NO: 1026 - protein, 218 aa, Oryza sativa; identical to SEQ ID NO: 944

SEQ ID NO: 1027 - protein, 219 aa, Oryza sativa
MDTEDTSSASSSSVSPPSSPGGGHHHRLPPKRRAGRKKFRETRHPVYRGVRARAGGSRWVCEVREPQAQARIWLGTYPTPEMAARAHDVAAIALRGERGAELNFPDSPSTLPRARTASPEDIRLAAAQAAELYRRPPPPLALPEDPQEGTSGGGATATSGRPAAVFVDEDAIFDMPGLIDDMARGMMLTPPAIGRSLDDWAAIDDDDDHYHMDYKLWMD

SEQ ID NO: 1028 - protein, 251 aa, Oryza sativa
MCTSKLEEITGEWPPPALQAASTTSSSEPCRRLSPPSSKRPAGRTKFHETRHPVFRGVRRRGRAGRWVCEVRVPGRRGCRLWLGTFDAADAAARAHDAAMLALRGRAAACLNFADSAWLLAVPPPATLRCAADVQRAVARALEDFEQRESSSSVFPLAIDVVAEDAMSATSEPSAASDDDAVTSSSSTTDADEEASPFELDVVSDMGWSLYYASLAEGLLMEPPASGASSDDDDDAIVDSSDIADVSLWSY

SEQ ID NO: 1029 - protein, 274 aa, Oryza sativa
MERGEGRRGDCSVQVRKKRTRRKSDGPDSIAETIKWWKEQNQKLQEENSSRKAPAKGSKKGCMAGKGGPENSNCAYRGVRQRTWGKWVAEIREPNRGRRLWLGSFPTALEAAHAYDEAARAMYGPTARVNFADNSTDANSGCTSAPSLMMSNGPATIPSDEKDELESPPFIVANGPAVLYQPDKKDVLERVVPEVQDVKTEGSNGLKRVCQERKNMEVCESEGIVLHKEVNISYDYFNVHEVVEMIIVELSADQKTEVHEEYQEGDDGFSLFSY

SEQ ID NO: 1030 - protein, 419 aa, Oryza sativa
MTVDQRTTAKAIMPPVEMPPVQPGRKCGGEESTGNLDSVQPIGALPCNEHALLAQQTPKGDAPSVGSKICRKKRPRRSRDGPTSVAETIKRWAELNNQQELDPQGPKKARKAPAKGSKKGCMKGKGGPENTRCDFRGVRQRTWGKWVAEIREPNQQSRLWLGTFPTAEAAACAYDEAARAMYGPMARTNFGQHHAPAASVQVALAAVKCALPGGGLTASKSRTSTQGASADVQDVLTGGLSACESTTTTINNQSDVVSTLHKPEEVSEISSPLRAPPAVLEDGSNEDKAESVTYDENIVSQQRAPPEAEASNGRGEEVFEPLEPIASLPEDQGDYCFDIDEMLRMMEADPTNEGLWKGDKDGSDAILELGQDEPFYYEGVDPGMLDNLLRSDEPAWLLADPAMFISGGFEDDSQFFEGL

SEQ ID NO: 1031 - protein, 492 aa, Oryza sativa
MAVASRLAVARVAPDGGAAGRRRRRGRPVVAVPTAGRGRGGAVAASPPTEEAVQMTEPLTKEDLVAYLVSGCKPKENWRIGTEHEKFGFEVDTLRPIKYDQIRDILNGLAERFDWDKIVEENNVIGLKQGKQSISLEPGGQFELSGAPLETLHQTCAEVNSHLYQVKAVGEEMGIGFLGIGFQPKWALSDIPIMPKGRYEIMRNYMPKVGSLGLDMMFRTCTVQVNLDFSSEQDMIRKFRTGLALQPIATAIFANSPFKEGKPNGYLSLRSHIWTDTDNNRSGMLPFVFDDSFGFERYVDYALDIPMYFVYRNKKYIDCTGMSFRDFMVGKLPQAPGELPTLNDWENHLTTIFPEVRLKRYLEMRGADGGPWRRLCALPVFWVGLLYDEESLQSISDMTSDWTNEEREMLRRKVPVTGLKTPFRDGYVRDLAEEILQLSKNGLERRGYKEVGFLREVDAVISSGVTPAERLLNLYETKWQRSVDPVFQELLY

SEQ ID NO: 1032 - protein, 95 aa, Oryza sativa
MASGQQQQGRSELDRMAREGQTVVPGGTGGKSLEAQENLAEGRSRGGQTRKEQMGEEGYREMGRKGGLSTGDESGGERAAREGIDIDESKYKTKS

SEQ ID NO: 1033 - protein, 383 aa, Oryza sativa
  MOD_RES (362)..(362): Any naturally occurring amino acid
MCGGAIIHHLKGHPEGSRRATEGLLWPEKKKPRWGGGGRRHFGGFVEEDDEDFEADFEEFEVDSGDSDLELGEEDDDDVVEIKPAAFKRALSRDNLSTITTAGFDGPAAKSAKRKRKNQFRGIRQRPWGKWAAEIRDPRKGVRVWLGTFNSAEEAARAYDAEARRIRGKKAKVNFPEAPTTAQKRRAGSTTAKAPKSSVEQKPTVKPAFNNLANANAFVYPSANFTSNKPFVQPDNMPFVPAMNSAAPIEDPIINSDQGSNSFGCSDFGWENDTKTPDITSIAPISTIAEVDESAFIKSSTNPMVPPVMENSAVDLPDLEPYMRFLLDDGAGDSIDSLLNLDGSQDVVSNMDLWSFDDMPVXRFLLRNSKSSSRSMYTGKKKE

SEQ ID NO: 1034 - protein, 318 aa, Oryza sativa
MMVPSSRKVRVFCSDPDATDSSDEDDQNKKERRFSREILIPMENSKASKPVKTLVQCGTKTVKDSEKEPTSKYRGVRRRAWGKWAAEIRDPVRKSRKWIGTFNSEEEAAAAYLAQSNQFHEELMALKIQSSVSEQEDLSSSVTISCVSSSQSCDQKIQAKPQEHKRVSVVVNRETVEQKFKAQPQAQKIKAQPEVQKRVSVKISHETEDEHLLNLPSTPKGKEISMGAVLGRIDEIPVSNCVGHIDEFPPDDFTRLADAFPVSDFIGMADVPLGDDYIGLADISHLPLPITDLKFDLNAELNWDGFDFASLEQELNCL

SEQ ID NO: 1035 - protein, 419 aa, Oryza sativa; identical to SEQ ID NO: 1030

SEQ ID NO: 1036 - protein, 235 aa, Oryza sativa; identical to SEQ ID NO: 933

SEQ ID NO: 1037 - protein, 280 aa, Oryza sativa
MAAAIEGNLMRALGEAPSPQMQKIAPPPFHPGLPPAPANFSSAGVHGFHYMGPAQLSPAQIQRVQAQLHMQRQAQSGLGPRAQPMKPASAAAPAAAAARAQKLYRGVRQRHWGKWVAEIRLPRNRTRLWLGTFDTAEEAALTYDQAAYRLRGDAARLNFPDNAASRGPLDAAVDAKLQAICDTIAASKNASSRSRGGAGRAMPINAPLVAAASSSSGSDHSGGGDDGGSETSSSSAAASPLAEMEQLDFSEVPWDEAEGFALTKYPSYEIDWDSLLNNNN

SEQ ID NO: 1038 - protein, 235 aa, Oryza sativa; identical to SEQ ID NO: 933

SEQ ID NO: 1039 - protein, 362 aa, Oryza sativa
MCGGAILSDLIPPPRRVTAGDLWLEKTKKQQQQKKKNKGARRLPLRQEEEDDFEADFEEFEVDSGEWEVESDADEAKPLAAPRSGFAKGGLKNTTVAGADGPAARSAKRKRKNQFRGIRQRPWGKWAAEIRDPRKGVRVWLGTFNSPEEAARAYDAEARRIRGKKAKVNFPDGAPVASQRSHAEPSSMNMPAFSIEEKPAVMSAGNKTMYNTNAYAYPAVEYTLQEPFVQIQNVSFVPAMNAIEDTFVNLSSDQGSNSFGCSDFSQENDIKTPDITSMLAPTMTGVDDSAFLQNNASDAMVPPVMGNASIDLADLEPYMKFLIDGGSDESIDTLLSSDGSQDVASSMDLWSFDDMPVSAEFY

SEQ ID NO: 1040 - protein, 212 aa, Oryza sativa
MSLSLGFSAGAGVGADRLAAAPALQAAGALPPRVDVSLSLARAANGQPSSYLPLNENDSLDMVLFDVLREASAVAALSSSSSSSPELGARTTAPVVAGHPAGRKGGGGGGGGRGAAARGGAAGGRHYRGVRRRPWGKYAAEIRDPTRHGARLWLGTFGTAEEAAAAYDRAAFRMRGAKALLNFPPAVAGDGARRGAAAAAKQVGMSDGECVI

SEQ ID NO: 1041 - protein, 413 aa, Oryza sativa
MARLLLSGVAPLPLLPCRRRAIAFALPLGNVRLRLRVAAPTSRVATVEEDDNENNAPPPPCEDFDPGAAPPFGLADIRAAIPKHCWVKDPWRSMGYVLRDVVVVFALAAAAARLHSCLAWPLYWAAQGTMFWALFVLGHDCGHGSFSNNSRLNSVMGHILHSSILVPYHGWRISHRTHHQNHGHVDKDESWHPLPERLYRSLNRATRMLRFSIPFPMLAYPFYLWSRSPGKSGSHFHPSSDLFQPNERNDVLTSTACWVAMAALLAGLTFLMGPLLMLNLYFVPYWIFVMWLDFVTYLHHHGHNDKLPWYRGKEWSYLRGGLTTVDRDYGWINNIHHDIGTHVIHHLFPQIPHYHLIEATEAAKGVMGKYYREPDKSGPFPLHLFGALSRSLKRDHYVSDTGDVVYYQTDPAN

SEQ ID NO: 1042 - protein, 186 aa, Oryza sativa
MAEVADLTGDGGVLKTVVRKAKDDAIAPTDSLPLVDVHYEGTLAENGEVFDTTHEDNSIFSFEIGQGAVIKAWDIALRTMKVGEVAKITCKPEYAYGSAGSPPEIPPNATLIFEVELVACRPRKGSSLGSVSDEKARLEELKKQRELAAATKEEEKKKREEAKAAAAARVQAKLDAKKGKGKGKGK

SEQ ID NO: 1043 - protein, 438 aa, Oryza sativa
MEMKLTIKRVPTVVSNYQEDAAATAGERPRAGCGRDCLGDCCLPDSKLPLYAFKASPKKPSSQEDASNDEFFVNLLLGLWEDRMARGLFRYDVTACETKVIPGNLGFVAQLNEGRHLKKRPTEFRVDRVLQPFDAAKFNFTKVGQEEVLFQFENGGGDDSFFVESSPISVADRAPNVVAINVSPIEYGHVLLIPRVLDRLPQRIDQESFLLALHMAAEAASPYFRLGYNSLGAFATINHLHFQAYYLTVPFPVEKAATKRIFLAEGTMNSGVKVSKLMNYPVRGLVFEGGNSLSDLANVVSSACIWLQDNNVPYNVLISDCGKKIFLFPQCYAEKQALGEVSQELLDTQVNPAVWEISGHIVLKRRSDYEEASEASAWRLLAEVSLSEERFEEVKAYIFDAAGLVQSDEEEVSEDEDATYTPVSIAPPAVAEGCLVLQ

SEQ ID NO: 1044 - protein, 628 aa, Oryza sativa
MAAPPLSSWPWASLGSYKYVLYGAVVWKVAEEWRQQGAAPVGSWWLHLLLLFAARGLTYQFWFSYGNMLFFTRRRRVVPDSVDFRQVDAEWDWDNFLLLQTLIGATLVGSPAVARQQLLLPSLKQAWDPRGWAIALLLHVLVAEPLFYWAHRALHRAPLFSRYHAAHHHASVTTPLTAGFGTPLESLLLTVVIGVPLAGAFLMGVGSVGLVYGHVLLFDFLRSMGYSNVEVISPRVFQAVPLLRYLIYTPTYLSLHHREKDSNFCLFMPIFDLLGGTLNHKSWELQKEVYLGKNDQAPDFVFLAHVVDIMASMHVPFVLRSCSSTPFANHFVLLPFWPVAFGFMLLMWCCSKTFLVSSYRLRGNLHQMWTVPRYGFQYFIPAAKKGINEQIELAILRADRMGVKVLSLAALNKNEALNGGGTLFVNKHPELRVRVVHGNTLTAAVILNEIPSNVKDVFLTGATSKLGRAIALYLCRKKIRVLMLTLSSERFLKIQREAPAEFQQYLVQVTKYQPAQNCKTWLVGKWLSPREQRWAPAGTHFHQFVVPPIIGFRRDCTYGKLAAMRLPKDVQGLGYCEYTMERGVVHACHAGGVVHFLEGWEHHEVGAIDVDRIDVVWKAALKHGLTPA

SEQ ID NO: 1045 - protein, 635 aa, Oryza sativa
MASKPGPLTQWPWHNLGNYKYALVAPSAAYSTYRFVTASSAAERDLLNFMVFPMLLLRLLYGQLWITVSRHQTARSKHKIVNKSLDFEQIDRERNWDDQIILTALVFYLVSATMPQAQVAPWWSTKGMVVTAVLHAGPVEFLYYWLHRALHHHWLYARYHSHHHASIVTEPITSVIHPFAEEVVYFVLLAIPILSTVATGTVSVVTANGYLVYIDFMNYLGHCNFELVPKCLFHVFPPLKYLLYTPSFHSLHHTQFRTNYSLFMPVYDYIYGTTDKSSDELYERTLQGRDEAAWRPDVVHLTHLTTPESVFHNRLGFAAVASNPLGAAASGHLLRAASAVASPLLSLFASTFRSEANRLDKLNIETWVIPRFTSHYTSKSDGYKVSRLIEKAVSDAEASGARVLTLGLLNQGYDLNRNGELYVVRKPSLKTKIVDGTSLAVAAVLNMIPQGTKDVLLLGNANKISLVLTLSLCKREIQVRMVNKELYECLKQQLQPEMQEHLVLSCSYSSKVWLVGDGVTDEEQMKAQKGSHFVPYSQFPPNKARNDCVYHCTPALLVPESFENLHVCENWLPRRVMSAWRAAGIVHALEKWDGHECGGRVTGVQKAWSAALARGFRPYDDHHHPGITHDGRGGL

SEQ ID NO: 1046 - protein, 378 aa, Oryza sativa
MGSSEKNGTAYGEYTYAELEREQYWPSEKLRISITGAGGFIGSHIARRLKSEGHYIIASDWKKNEHMTEDMFCHEFHLVDLRVMDNCLKVTNGVDHVFNLAADMGGMGFIQSNHSVIMYNNTMISFNMLEAARINGVKRFFYASSACIYPEFKQLETNVSLKESDAWPAEPQDAYGLEKLATEELCKHYTKDFGIECRVGRFHNIYGPFGTWKGGREKAPAAFCRKAQTSTDRFEMWGDGLQTRSFTFIDECVEGVLRLTKSDFREPVNIGSDEMVSMNEMAEIILSFEDRELPIHHIPGPEGVRGRNSDNTLIKEKLGWAPTMKLKDGLRFTYFWIKEQIEKEKTQGVDIAGYGSSKVVSTQAPVQLGSLRAADGKE

SEQ ID NO: 1047 - protein, 371 aa, Oryza sativa
MALNEEYTYVELEKEPYWPFEKLRISITGAGGFIASHIARRLKSEGHYIIASDWKKNEHMTEDMFCHEFHLVDLRVMDNCLKVTTGVDHVFNLAADMGGMGFIQSNHSVIMYNNTMISFNMLEAARINGVKRFFYASSACIYPEFKQLDTVVSLKESDAWPAEPQDAYGLEKLATEELCKHYTKDFGIECRVGRFHNIYGPFGTWKGGREKAPAAFCRKALTSTDRFEMWGDGLQTRSFTFIDECVEGVLRLTKSDFREPVNIGSDEMVSMNEMAEIVLSFENKQLPIHHIPGPEGVRGRNSDNTLIKEKLGWAPTMRLKDGLRITYFWIKEQLEKEKAEGVDLSAYGSSKVVQTQAPVQLGSLRAADGKE

SEQ ID NO: 1048 - protein, 636 aa, Oryza sativa
MLDSGSYDDVDYGDLFSIPNPPAPHLLNFPLQFFPSNGFISSADDSHRSPAGMFGSTPSPTSTTTELENSEDLSESADDAVLAYINQFLLEDEEDESCPGTITSVEDSALLAVEKPFVDILTASQEACQENSWIDSCCDFTGNGGLLDTFTTTHAACQPAPCEFEKEKGECAVHKGRKNPHDDCLLFEEESRRSKQLAVSEEETVREMFDKVLLCNGECELRAPLPAEARNCGVYVKGSGNKRGRKKGKSGASAEDDAVDLTTLLIHCAQAAAIDDHRNSNELLKQIRQRSSAYGDAGQRLAHCFANALEARLAGTGSNIYRSLAAKRTSVYDILNAFKLYVTACPFKKISNFFSIEAILNASKGMTRLHIVDYGIQYGFQWPIFFQRISKRPGGPPSVRITGVDLPQPGFRPAQLIEATGRRLHDYARMFNVPFEYHAIAAKWDTIRVEDLKIDKDKDELLVVNCLFRMRNMMDEMVTDDSPRMQVLKTIRKMNPNLFIHGVVNGTYNAPFFVTRFKEALFYYSSLFDMLETTASRVDENRLLIERDLFGREALNVVACEGTERVERPETYKQWQVRNIRAGFKQLPLNQETVKKARYKVKKSYHRDFLVDEDNKWMLQGWKGRIIFALSAWEPN

SEQ ID NO: 1049 - protein, 135 aa, Oryza sativa
MQYGAAAEQAWYMPAAAPAPMVESAVARVERLASESAVVVFSVSSCCMCHAVKRLFCGMGVHPTVHELDLDPRGRELERALARLVGYGGPAAASPPVVPVVFIGGKLVGAMDRVMAAHINGSLVPLLKEAGALWL

SEQ ID NO: 1050 - protein, 356 aa, Oryza sativa
MASLTDLVNLNLSDTTEKIIAEYIWIGGSGMDLRSKARTLSGPVTDPSKLPKWNYDGSSTGQAPGEDSEVILYPQAIFKDPFRKGNNILVMCDCYTPAGEPIPTNKRHNAAKIFSSPEVASEEPWYGIEQEYTLLQKDINWPLGWPVGGFPGPQGPYYCGIGADKSFGRDIVDSHYKACLYAGINISGINGEVMPGQWEFQVGPSVGISAGDQVWVARYILERITEIAGVVVSFDPKPIPGDWNGAGAHTNYSTKSMRNDGGYEIIKSAIEKLKLRHKEHISAYGEGNERRLTGRHETADINTFSWGVANRGASVRVGRETEQNGKGYFEDRRPASNMDPYIVTSMIAETTIIWKP

SEQ ID NO: 1051 - protein, 233 aa, Oryza sativa
MHKHMAPNHPPAMEAAPEHGGRSSSSSTDPELDQHNKGILEKMHKSLLLLAILAATVTYNAGLAPPGGVWADDADGHVAGDSVLQAHYPVRYSVFFYCNATAFVASLVITMLLLSSTFSFHGYRVRALQAAMALDLIGLLGAFAAGGCRSVRTSAFVLALVAVIAAYLVAHLLLHFWIRSSRCPSHRRELVELLNLHRCHSCCVGAAAAKDDATTVAQAGTEAPAAPKRASSV

SEQ ID NO: 1052 - protein, 317 aa, Oryza sativa
MIMLLQEMENHPVQCMAKTNYDFLARNNYPMKQLVQRNSDGDSSPTKSGESHQEASAVSDSSLNGQHTSPQSVFVPSDINNNDSCGERDHGTKSVLSLGNTEAAFPPSKFDYNQPFACVSYPYGTDPYYGGVLTGYTSHAFVHPQITGAANSRMPLPVDPSVEEPIFVNAKQYNAILRRRQTRAKLEAQNKAVKGRKPYLHESRHHHAMKRARGSGGRFLTKKELLEQQQQQQQQKPPPASAQSPTGRARTSGGAVVLGKNLCPENSTSCSPSTPTGSEISSISFGGGMLAHQEHISFASADRHPTMNQNHRVPVMR

SEQ ID NO: 1053 - protein, 329 aa, Oryza sativa
MADMSPRTDTSTDDTDDNHMLEPGQLALAAASDSDRSKDKHEDQKTLRRLAQNREAARKSRLRKKAYVQQLENSRLKLTQLEQELQRARQQGIFISSSVDQTHSMSGNGALAFDMEYARWLEEHNRQINELRSAVNAHAGDNELRGVVDKIMSHYEEIFKQKGNAAKADVFHVLSGMWKTPAERCFLWLGGFRPSELLKLLSTQLEPLTEQQLSGIANLQQSSQQAEDALSQGMEALQQSLAETLAGSLGSSGSTGNVANYMGQMAMAMGKLGTLENFLRQADNLRQQTLQQMQRILTTRQSARALLVISDYSSRLRALSSLWLARPKE

SEQ ID NO: 1054 - protein, 552 aa, Oryza sativa
MHPPSLVLDTLKRIKLYIAMKLLLPNSEVPRIYWEKAQHLCGFLSMKLISRARCVASSVKQSYSFLVCKSNPLVVQLVYFVIISFAGFLALKNLKPQGKPGPKDLDLLFTSVSTLTVSSMATVEMEDLSDRQLWVLILLMLMGGEVFTSMLGLYFNNANANRNENSQRSLPSISLDIEFNSPANNGDHKITECGQSEETMSQNQVQQNKSITYNPCAVLVRIVTGYFVATVISSSVIIIIYFWIDSDARNVLKSKEINMYTFCIFTAVSSFANCGFTPLNSNMQPFRKNWVLLLLVIPQILAGNTLFSPLLRLCVWVLGKVSGKAEYAYILQHPGETGYKHLHVRRNSVYIVLSVTGLILLQVMFICSFEWNSESLEGMNWLQKLVGLLFQSVNTRQAGESILDISTLSPSTLLLFAVVMYLPSDASFLTANADNQPLTDKKTNSISRALWRNFTVNKLSCLAMFTFLACITERKSISSDPLNFNIFSIVFEIISAFGNVGYSLGYSCQKLLKPDATCKDASYGFVGRWTEEGKLIVILVMFLGRLKEFILK

SEQ ID NO: 1055 - protein, 554 aa, Oryza sativa
MSSLDATTPRYDEFKRIYHLFLFHAHPFWLQLLYFLFISLLGFLMLKALPMKTSMVPRPMDLDLIFTSVSATTVSSMVAVEMESFSNSQLLLITLLMLLGGEVFTSILGLYFTNAKYSSKMIATLPDDDDHGGSGKPPPPTTSPSSTLVELELAPPMDVVVVNPTTTATTHDEVELGLGRRNKRGCTCTTTHTSSSSSASKTTTTRLLMFVVMGYHAVVHVAGYTAIVVYLSAVGGAGAVVAGKGISAHTFAIFTVVSTFANCGFVPTNEGMVSFRSFPGLLLLVMPHVLLGNTLFPVFLRLAIAALERVTGWPELGELLIRRRRGGGEGYHHLLPSSRTRFLALTVAVLVVAQLALFCAMEWGSDGLRGLTAGQKLVGALFMAVNSRHSGEMVLDLSTVSSAVVVLYVVMMYLPPYTTFVPVQDKHQQTGAQSGQEGSSSSSIWQKLLMSPLSCLAIFIVVICITERRQIADDPINYSVLNIVVEVISAYGNVGFSTGYSCARQVRPDGSCRDLWVGFSGKWSKQGKLTLMAVMFYGRLKKFSLHGGQAWKIE

SEQ ID NO: 1056 - protein, 261 aa, Oryza sativa
MESDCQFLVAPPQPHMYYDTAAAAVDEAQFLRQMVAAADHHAAAAGRGGGDGDGGGGGGGGGERKRRFTEEQVRSLETTFHARRAKLEPREKAELARELGLQPRQVAIWFQNKRARWRSKQIEHDYAALRAQYDALHARVESLRQEKLALADQVDELRGKLNERQDQSGSCDGGGAEGDDDDKRNSVMNASSSGLVEEDYVSCLAVPVVDVSEDGSAACGGSSYEYDHHLDYLGGGQLPDPFCGMPDLWEIWPMVEWNAVA

SEQ ID NO: 1057 - protein, 606 aa, Oryza sativa
MENQFQDGKEEVIEAWYMDDSEEDQRLPHHREPKEFIPLSKLSELGILSWRLNADDWENDENLKKIREARGYSYMDICDVCPEKLPNYEAKLKNFFEEHLHTDEEIRYCLEGSGYFDVRDQNDQWIRVAVKKGGMIVLPAGMYHRFTLDSDNYIKAMRLFVGEPVWTPYNRPHDHLPARKEYVEKIINRGGTQAVEARARCQARRILFLDWSRLGGDDGEDDAGDGEGGVAAELAGGGGGAEAHGGAARGRAAAVPDQDVRPGGRPGHRRRRLVGPRGQQLRRLGPPRLRRRLPPTLLQAQQFLQLRPPAQHLPRWIKTADEATRICLFVLEDSFDHHQKKEKGFRKIDPDRWEFANDGFLRGQRHLLKMIKRRRPLSYLPGSQQALGTCLEVGQFGLDEEIDRLKRDKNILLAEVVKLRHKQQSTKANMRAMEERLQHAEQKQVQMMGFLARAMQNPDFFHQLIHQQDKMKGLEDTFSKKRTRSIDIVPFLNPGEVSQGDQLESTLLFDPRPFAELNDEPAKSELENLALNIQGLGKGKQDVNRTRNQPRNQASNETELTDDFWEELLNEGARDDAGIPGMERRRPRYVDALAQKLGYLSNSSQK

SEQ ID NO: 1058 - protein, 616 aa, Oryza sativa
MKGSRLAVKESCLPMTMPMPETFAQYSNPLRSTRAYGQLCRVPGRRRHACVDGWGQDRARTRGDDGQRRYAQCRGGWGDIWRWGGYITCGSPRETGMVNGAPSPPPPSPMVMSFGPLDSPWVKQPDTTVYPGQICAAAGGGGGMADQTAAAVVVGGGAAATMGEPSPPPPAPAAEAAGVGVGQQQRTVPTPFLTKTYQLVDDPAVDDVISWNDDGSTFVVWRPAEFARDLLPKYFKHNNFSSFVRQLNTYGFRKIVPDRWEFANDCFRRGERRLLCEIHRRKVTPPAPAATTAAVAAAIPMALPVTTTRDGSPVLSGEEQVISSSSSPEPPLVLPQAPSGSGSGGVASGDVGDENERLRRENAQLARELSQMRKLCNNILLLMSKYASTQQLDAANASSAAGNNNNNNCSGESAEAATPLPLPAVLDLMPSCPGAASAAAPVSDNEEGMMSAKLFGVSIGRKRMRHDGGGDDDHAATVKAEPMDGRPHGKDEQSAETQAWPIYRPRPVYQPIRACNGYEYDRAGSDQDECGAKPSNQDKKDLLRRWVVLISESLQLHGRQVVGAVQEWRRDRRGHRRPPAGHVQLRTCVNNLLVTGAGTLDAGREYETNSLPRPRR

SEQ ID NO: 1059 - protein, 912 aa, Oryza sativa
MNPDNFTHKTNEALVAAHEIASEAGHAQLTPLHLVAALAADKGGILRQAISQASGGDAGAPDSFERVVSGALKKLPSQSPPPDSVPASTALIKVIRRAQSAQKKRGDSHLAVDQLLLGLLEDSLISDCLKEAGVSAARVRAELEKLRGGEGRKVESASGDTNFQALKTYGRDLVEQAGKLDPVIGRDEEIRRVVRILSRRTKNNPVLIGEPGVGKTAVVEGLAQRIVRGDVPSNLLDVRLIALDMGALVAGAKYRGEFEERLKAVLKEVEEAEGKVILFIDEIHLVLGAGRTEGSMDAANLFKPMLARGQLRCIGATTLEEYRKYVEKDAAFERRFQQVFVAEPSVPDTISILRGLKEKYEGHHGVRIQDRALVVAAQLSARYIMGRHLPDKAIDLVDEACANVRVQLDSQPEEIDNLERKRIQLEVEHHALEKEKDKASKARLVEVKKELDDLRDKLQPLTMKYRKEKERIDEIRKLKQRREELQFTLQEAERRMDLARVADLKYGALQEIDVAIAKLESETGENLMLTETVGPEQIAEVVSRWTGIPVTRLGQNDKERLVGLADRLHQRVVGQAEAVSAVAEAVLRSRAGLGRPQQPTGSFLFLGPTGVGKTELAKALAEQLFDDENLLVRIDMSEYMEQHSVARLIGAPPGYVGHEEGGQLTEQVRRRPYSVILFDEVEKAHVAVFNTLLQVLDDGRLTDGQGRTVDFRNTVIIMTSNLGAEHLLAGMVGKNSMKVARDLVMQEVRRHFRPELLNRLDEIVIFDPLSHEQLRKVARLQMKDVAVRLAERGVALAVTDAALDVILSLSYDPVYGARPIRRWIEKRVVTQLSKMLIQEEIDENCTVYIDAAPHKDELAYRVDNRGGLVNAETGQKSDILIQVPNGAATGSDAAQAVKKMRIMEDEDGMDEE

SEQ ID NO: 1060 - protein, 150 aa, Oryza sativa
MSLVRRSNVFDPFSLDLWDPFDSVFRSVVPATSDNDTAAFANARIDWKETPESHVFKADLPGVKKEEVKVEVEEGNVLVISGQRSKEKEDKNDKWHRVERSSGQFMRRFRLPENAKVDQVKAGLENGVLTVTVPKAEVKKPEVKAIEISG

SEQ ID NO: 1061 - protein, 150 aa, Oryza sativa
MSLVRRSNVFDPFSLDLWDPFDSVFRSVVPATSDNDTAAFANARIDWKETPESHVFKADLPGVKKEEVKVEVEEGNVLVISGQRSKEKEDKNDKWHRVERSSGQFMRRFRLPENAKVDQVKAGMENGVLTVTVPKAEVKKPEVKAIEISG

SEQ ID NO: 1062 - skipped

SEQ ID NO: 1063 - protein, 524 aa, Oryza sativa; identical to SEQ ID NO: 974

SEQ ID NO: 1064 - protein, 412 aa, Oryza sativa; identical to SEQ ID NO: 973

SEQ ID NO: 1065 - protein, 267 aa, Oryza sativa
MPISERATTTPSSSYYSLELDPLLSDLAEKKLSLRRSLAWLDAELKDAKIKLASKEQLLAQESENRKKFAESRARSMEEEVKKLHKCLQDKDEQLRTSICSTEQYLSSYKLDILRSQISVAQATAEASAESAMLARLQCLSLSGGHEKINSLGECELRVKKVEEQLDLVQKFLEAKELSQLEKNQMTTVHELKKKVLKLECTLKVSRAQLRKLHKMVERRDKPLKKLQSRLPLKQQTACDKQKLWESSGFRIIASMSILALAMLSKR

SEQ ID NO: 1066 - protein, 267 aa, Oryza sativa
MAEEQFLAVAVDAAKNAGEIIRKGFYQTKNVEHKGQVDLVTETDKACEDLIFNHLRKHYPDHKFIGEETSAALGATADLTDDPTWIVDPLDGTTNFVHGFPFVCVSIGLTVGKIPTVGVVYNPIMNELFTAVRGKGAFLNGSPIKTSSQNELVKALLVTEVGTKRDKATLDDTTNRINKLLFKIRSIRMCGSLALNMCGVACGRLDLCYEIGFGGPWDVAAGALILREAGGFVFDPSGGEFDLMARRMAGSNSYLKDQFIKELGDTS

SEQ ID NO: 1067 - protein, 164 aa, Oryza sativa
MAQRDKKDQEPTELRAPEITLCANSCGFPGNPATQNLCQNCFLAATASTSSPSSLSSPVLDKQPPRPAAPLVEPQAPLPPPVEEMASALATAPAPVAKTSAVNRCSRCRKRVGLTGFRCRCGHLFCGEHRYSDRHGCSYDYKSAARDAIARDNPVVRAAKIVRF

SEQ ID NO: 1068 - protein, 179 aa, Oryza sativa
MASTDPMTRRFAVACGVLSQYVKANSSQPSTAAPVAQGVSGLMAAAAAAAAAPVVQEPGCEVDGGGQQFTIFYAGKVVVIDRCTPAMAAELMRFASAAQGGGGAPEAPPALVDMPIARKASLKRFLAKRKATPASARSSYVVRAAAAEEEQPPAKKAKAAVERREDWLALGSLGHMHSR

SEQ ID NO: 1069 - protein, 579 aa, Oryza sativa
MGTAKLPALLWLLAGVVLALAVNPAHGAKTRHYDFFITETNYTRLCHEKSILTVNGQFPGPTIYARKGDLVIVNVHNNGNKNITIHWHGVDQPRNPWSDGPEFITQCPIRPGGNFTYQVILSEEEGTLWWHAHSDFDRATVHGAIVIHPKRGTTFPFKKPDKEIPVILGEWWNDDIEHVLDKAQLLGGDVDPSNANTINAQPGDMFPCSRDDTFKVAVQQGNTYLLRIINAGLTNDMFFAIAGHRLTVVGIDARYTKPLTVDYIMIAPGQTMDVLLEAKRTLGSNSRYYMAARTFITLPLDTIPFNNSTATAIVEYTDSVTARPVGPPEFPVQLPAIKDENAAMAFVTQLRSLGNQEHPVHVPTHVDEHMLIDIDINVLPCDPTNMAEKCKEGPQGNRFAASLNNVSFQSPAIDVLDAYYYSSGHGVYEEDFPNKPTAFVDPPVNNGSGPLMTKRGTKVKVLEYGTVVEVVFHDLSSENHPMHLHGFAFYVVGRGNGTFDESRDPATYNLVDPPFQNTVSVPRSGWAAIRFRADNPGVWFMHCHFDRHVVWGMDTVFIVKDGKTPQAQMLPRPPNMPQC

SEQ ID NO: 1070 - protein, 200 aa, Oryza sativa
MASHQDQASYRAGETKAHTEEKAGQVMGASKDKASEAKDRASEAAGHAAGKGQDTKEATKEKAQAAKERASETAQAAKDKTSSTSQAARDKAAESKDQTGGFLGEKTEQAKQKAAETAGAAKQKTAETAQYTKDSAIAGKDKTGSVLQQASEQVKSTVVGAKDAVMSTLGMTEDEAGTDDGANKDTSATAAATETTARDH

SEQ ID NO: 1071 - protein, 344 aa, Oryza sativa
MASRQDRREARAEADARRAAEEIARARDERVMQAEVDARSAADEIARARADRGAATMGADTAHHAAGGGGILESVQEGAKSFVSAVGRTFGGARDTAAEKTSQTADATRDKLGEYKDYTADKARETNDSVARKTNETADASRDKLGEYKDYTADKTRETKDAVAQKASDASEATKNKLGEYKDALARKTRDAKDTTAQKATEFKDGVKATAQETRDATADTARKAKDATKDTTQTAADKARETAATHDDATDKGQGQGLLGALGNVTGAIKEKLTVSPAATQEHLGGGEERAVKERAAEKAASVYFEEKDRLTRERAAERVDKCVEKCVEGCPDATCAHRHGKM

SEQ ID NO: 1072 - protein, 1463 aa, Oryza sativa
MASLPEAPVPPESARMGSPPPSHSPSPPPLQGDPSLPTDAPPPEPSPQPHHATPIPPPSPGQATEGWPRAEEPQPPIGGTPGAAGPPAPPSFFPSLELGTSAAPPALEAAAAGAGQPGSPSPCPPAEPAAEFYPGSAASSPSSSSYETAEDDSPASPPPTPPPLVLCASPDSSYTESSPTRDRFGDEEGSHAAPEPPPPPTPLEGGPDASSAEPAAMASRAREPMGSRTAPEPPTPPLESGQEGFQQQQPHPPPTTHPECDSSEPAELPLPPTSPAEIAYTSPDSVEVDVVAVSPEEAPGSTVAMEVMYGETDTSAVSVSPVLGSAETDAAEIDVIAGMQEEAPGSTVAMEVMYRENDTAAVSVSPVLESREPDVAEGDVVSGVQEAHGSKFSMEVMYRETDAAAVSVSPVLESGEPDKAENDAVEEMQEEAHGSRFAMEATYGEPDASAVSVSPVLESVEPDVTEIDVVSEIQEEAPDSTLAMEVTSGETDTAAVSAFPVLDGGDPDAAEKNVVAGMQEEEAPDSTLAIEVTSGETDTAAVSVSPVLEGVDPDAAEIDVVAGMQEEAPGSTLAMEVTYRETDATAASVSPVLDSGDPDAAEVDVVVGMQEQAAGSALAMLVTYGETDTSAVSVSPVLESGEPDAAQIDVVAGMQEEAPGSMLAMEVTYREVDAATVSVSPVLESVEPDAAKIDVVARMQEEAPGSKLAMEVMYGETGTAAVSVPLVLESREEGSLQESMQRPSSPTMNIEQESMQRPFSPTIGTETSSPEMAPAGSENCKVSWLPLPPPTPLGESMPSLPVAAAPKVLLVMPEEAVESVPSSEALDVEKPASITQAEPSSPNTPPPGFENFKSSWLPLPTTPPPVETTDVLPDVVVTKAVEAPIEEVSRPLPALEVTNMESDTVLSILPTTVLPTEGTEGLLQQPLLRPPSPVVQSEPCLQNEMAPPGFENFKSSSEPCSAEEIAPPGSDNFKSSSEPCLPEEMAPPGFENFKSSSEPCSQEEMAPPGFENFKSSWPPLPTLPQTVPDAAAADALAATVEEAAGPPPALELEAMDVDMDAIHPPPLPFDSGVESLQKPLPRAPSPIMQEAPCSPDRAPPGFETYKSSQLLLPSPSLAQTTNVRQDQSVTEPVSVIEEAPQLLHSVEVMGVHMDAVPPLLPSSESGADGLSPQQFAQPPPAEKDTTTCLPDMVHSGCDNSEPSQLLSLPAVISPVQTPDGLADVPAIDRVAVALEESPQRPLVSGEMEAGTVPIRSSPLKNISEGSLPQLESESHSPTSQAADSLLDASDSKSVAVASEEMSQLPLASQATTTDLVSTTAMQPQSEGIVDESLQPQHPPSSTAHDSPCLQDSVPLVPPPPSPYLNKEVGQMVCGSCRILLAYFRGAGYVHCTCCQTMNYVLEAHEVGKVHCGHCATLLMYPFGAPAVKCSLCLFVTEIGERNVRRRLSIEQPTRTNSSGLAEA

SEQ ID NO: 1073 - protein, 249 aa, Oryza sativa
MARNKVKLQRIINDAKRRATFKKRLKGLMKKASELATLCNVDTCLMVYGEGEAQATVVWPSESEVMRVLERFKTLPQLDKYKKMTDLEGFIQERINKFQEQLDKVRRDADESETKLLLIEALEGRRPGLEGITIEQLTSLGWLVDARLNIVNDQLQKLHEQGLLPASISLPTMGVLPYTTAGYTVAQEAPIQRGGWLMGVVRGIGSLGYSLFRGSGRSNTAGPSGDMVQPFNIGAGSSLANQGISFPPK

SEQ ID NO: 1074 - protein, 397 aa, Oryza sativa
MDGAPVAEFRPTMTHGGRYLLYDIFGNKFEVTNKYQPPIMPIGRGAYGIVCSVMNFETREMVAIKKIANAFNNDMDAKRTLREIKLLRHLDHENIIGIRDVIPPPIPQAFNDVYIATELMDTDLHHIIRSNQELSEEHCQYFLYQILRGLKYIHSANVIHRDLKPSNLLLNANCDLKICDFGLARPSSESDMMTEYVVTRWYRAPELLLNSTDYSAAIDVWSVGCIFMELINRQPLFPGRDHMHQMRLITEVSELISVDTHTLNYATCSWVSSCWVHDQVIGTPTDDELGFIRNEDARKYMRHLPQYPRRTFASMFPRVQPAALDLIERMLTFNPLQRITVEEALDHPYLERLHDIADEPICLEPFSFDFEQKALNEDQMKQLIFNEAIEMNPNIRY

SEQ ID NO: 1075 - protein, 508 aa, Oryza sativa
MAASSSSSSSMASPRGRSIRETVLETVAAYHQQQRMRRKFRKSLSYAGELSSAGRARGEGGASSSASTTSLCGPDEDDEPFWEEEEGTVELVQLGANRAKNVLILMSDTGGGHRASAEAIKDAFRIEFGDDYRVFVKDLCKDHAGWPLNNMESSYKFMVKHVQLWKVAFHTTSPRWVHCFYLAALASFYAKKVEAGLKKYKPDIIISVHPLMQHIPLWVLKWQGLQNRVVFVTVITDLNTCHPTWFHADVNRCYCPSEEVAKRAALDDLQPSQIRVFGLPIRPSFCRAVLVKDDLRKELELDPELPAVLLMGGGEGMGPVKKTAKALGESLFDKELGKPIGQLIVICGRNKTLSSSLQALEWKIPIKVRGFETQMEKWMGACDCIITKAGPGTIAEALIRGLPIILNDFIPGQEVGNVPYVVDNGAGVFSKSSRETAKLVARWFGPDSDELKRMSEKALKLAQPEAVFDIVRDIHELSREQGVISQISSSLTSSFFIPSPETTPIQLM

SEQ ID NO: 1076 - protein, 308 aa, Oryza sativa
MTITIEQPHLDAIADRKVAGGGGGDNAAELVLDGGFVVPDSNAFGNAFRNYEAESERKETVEEFYRVNHINQTYDFVRRMREEYGRVDKTEMGIWECIELLNEFIDDSDPDLDMPQIEHLLQTAEAIRKDFPDEDWLHLTGLIHDLGKVLLHPSFGELPQWSVVGDTFPVGCAFDECNVHFKYFKENPDYLNPKLNTKFGAYSEGCGLDNVLMSWGHDDYMYLVAKENKTTLPSAGLFIIRYHSFYPLHKHGAYMHLMNDEDKENLKWLRVFNKYDLYSKSNERIDVEKVKPYYMSLIEKYFPAKLRW

SEQ ID NO: 1077 - protein, 361 aa, Oryza sativa
MKALILVGGFGTRLRPLTLSFPKPLVDFANKPMILHQIEALKEVGVTEVVLAINYRPEVMLNFLKDFEDKLGITITCSQETEPLGTAGPLALARDKLVDGSGEPFFVLNSDVISEYPFAELIKFHKSHGGEATIMVTKVDEPSKYGVVVMEEVTGMVEKFVEKPKIFVGNKINAGIYLLNPSVLDRIELKPTSIEKEVFPRIASDAKLFALVLPGFWMDVGQPRDYITGLRLYLDSLRKRSTNRLATGAHIVGNVLVHESAKIGEGCLIGPDVAIGPGCVVEDGVRLSRCTVMRGVHIKKHACISNSIIGWHSTVGQWARIENMTILGEDVHVGDEVYTNGGVVLPHKEIKSSILKPEIVM

SEQ ID NO: 1078 - protein, 151 aa, Oryza sativa
MVVASAASPCESSALFATFDHDGDGRISAAELRLCMKTTLGEEVSDEEAGQLVASVDADGDGLLCEAEFVRLVQAAEVEEEDERRGTGLREAFGMYEMEGEGCITPTSLRRMLRRLGSDQDIDDCRAMICRFDLNGDGVLSFDEFKIMMNA

SEQ ID NO: 1079 - protein, 74 aa, Oryza sativa
MSCSCGSSCSCGSNCSCGKKYPDLEEKSSSTKATVVLGVAPEKKAQQFEAAAESGETAHGCSCGSSCRCNPCNC

SEQ ID NO: 1080 - protein, 329 aa, Oryza sativa
MDMAHERDASSEEEVMGGDLRRGPWTVEEDLLLVNYIAAHGEGRWNSLARSAGLKRTGKSCRLRWLNYLRPDLRRGNITPQEQLLILELHSRWGNRWSKIAQHLPGRTDNEIKNYWRTRVQKHAKQLKCDVNSQQFKDVMRYLWMPRLVERIQAAAAGQQQQQEGGTDTPPLSWQHGGSDGLYESPELPAPDASCWPAEYCAAAGGAQSGGTPAPELSSTTAGSSSLSTDSGAGAQPSWPTQADGAEWFTTACDASSATGGVAMRDTELELAQPPCQGGQTWTTSESSLPGLTFPDLAVADFEIGGFDVDSFWTSMEDDQLWCPTQAAV

SEQ ID NO: 1081 - protein, 258 aa, Oryza sativa
MGRAPCCEKMGLKRGPWTAEEDRILVAHIERHGHSNWRALPRQAGLLRCGKSCRLRWINYLRPDIKRGNFTREEEDAIIHLHDLLGNRWSAIAARLPGRTDNEIKNVWHTHLKKRLEPKPSSGREAAAPKRKATKKAAAVAVAIDVPTTVPVSPEQSLSTTTTSAATTEEYSYSMASSADHNTTDSFTSEEEFQIDDSFWSETLAMTVDSTDSGMEMSGGDPLGAGGASPSSSNDDDMDDFWLKLFIQAGGMQNLPQI

SEQ ID NO: 1082 - protein, 587 aa, Oryza sativa
MGAMAMVEQEGCVENRQPLAASSSSVSDGSSYGGGGGGLAQMSPPVSSSANSISGLRRTSGPIRRAKGGWTPEEDETLRKAVEAYKGRNWKKIAECFPYRTEVQCLHRWQKVLNPELIKGPWTQEEDDQIIDLVKKYGPTKWSVIAKALPGRIGKQCRERWHNHLNPEIRKDAWTTEEEQALINAHRIYGNKWAEIAKVLPGRTDNSIKNHWNSSLRKKQDMYNTSNNMVVPKLLVHDKFKDKPKLMAMEGHLDLNKAPIINSKDQPGTAHRSNCSGFLSRSSLPTAQPLTSREASVVDGSAVTLVAQALESDSVRGKGLEIDSVHEKGLEVNSAPDHTGNSWTIQLEAAPSKGEAELSLKNEARSLGPLCYQIPNMEDVVPVSSSLFSDHLTGNHTSEHCGDDILSPAGCTTPPPTKGKLTSQLSVDSILKSAANSFPGTPSILKRRKRDKSTPVSASEMKISGSNTDRFYTPMGMEPATATPESFKTTSFLSLGSLDGSVKSFDVSPQYRARSKRMALTKTVEKQLDFSSDGLDTCGSEILNSSCNNSQSTLSITEAPKLKEKEHAVQLENLTKNFAHTTNLDVT

SEQ ID NO: 1083 - protein, 257 aa, Oryza sativa
MGRAPCCEKMGLKKGPWTPEEDKVLVAHIQRHGHGNWRALPKQAGLLRCGKSCRLRWINYLRPDIKRGNFSKEEEDTIIHLHELLGNRWSAIAARLPGRTDNEIKNVWHTHLKKRLDAPAQGGHVAASGGKKHKKPKSAKKPAAAAAAPPASPERSASSSVTESSMASSVAEEHGNAGISSASASVCAKEESSFTSASEEFQIDDSFWSETLSMPLDGYDVSMEPGDAFVAPPSADDMDYWLGVFMESGEAQDLPQI

SEQ ID NO: 1084 - protein, 276 aa, Oryza sativa
MVVAGKKQGRHSFSASSSSSSSSSCSVVQLGHHQRPQGEDPLIGIKAAAAGGGGIMRKGPWTEQEDVQLVWFVRLLGERRWDFLAKVSGLQRSGKSCRLRWVNYLHPGLKRGRMSPEEERMVVQLHAKLGNRWSRIAKSIPGRTDNEIKNYWRTHLRKLKLKQQKQQQSDDHHNDNDDDDDRNSSSSSSSSNSNSNLQQQPQPEDESSASGSLQAQHHEDQHQLFLHPLWNDDIIVDVDCWSSSTNVVAPPPMPASPLWDIDDAFFCSDYSLPLWG

SEQ ID NO: 1085 - protein, 463 aa, Oryza sativa
MARFQETKARNDQGPVADHVGHQNLMENLTDPLDSSGMDMMDEARIPKARKPYTITKQREKWTEDEHKLFLEALQLHGRAWRRIQEHIGTKTAVQIRSHAQKFFSKVIKESSGDNCNSLGAASSIQIPPPRPKRKPVHPYPRNLGSTASKNVPALKQLEKPQLQVQSLYDQDNGSPTSVLTVPQIRADTLGSESGGSPTSTIDIEERCPTPSIATAELAMELPPTNDEEVKGNGDHEEVTCDRSGVPVLRLFGKRVMVNDLHQMSAPDAGNLQTVADMEVDASAETPTSGTGKFSSHGAAEANTWNPWLTNTQQFLYYLPNGQIFSVHSALPCFTYHNEGVTCTQFSNPQVVASDQQHQHQTSEAVDYKGIQREGSWTESNTSSSSVPETATHNSETTESYRNGNRNEDEMVPSPDSRKCVSPGSNCRRGFVPYKRCVADSEALLKSQAPQEEADGEMTRLCL

SEQ ID NO: 1086 - protein, 289 aa, Oryza sativa
MGRAPCCDKASVKRGPWSPEEDEQLRSYVQSHGIGGNWIALPQKAGLNRCGKSCRLRWLNYLRPDIKHGGYTEQEDHIICSLYNSIGSRWSIIASKLPGRTDNDVKNYWNTKLKKKAMGAVQPRAAASAPSQCTSSAMAPALSPASSSVTSSSGDACFAAAATTTTTMYPPPTTPPQQQFIRFDAPPAAAAAASPTDLAPVPPPATVTADGDGGWASDALSLDDVFLGELTAGEPLFPYAELFSGFAGAAPDSKATLELSACYFPNMAEMWAASDHAYAKPQGLCNTLT

SEQ ID NO: 1087 - protein, 342 aa, Oryza sativa
MQPPPMRERQRWRPEEDAILLAYVRQYGPREWSLVSQRMNRPLHRDAKSCLERWKNYLRPGIKKGSLTDDEQRLVIRLQAKHGNKWKKIAAEVPGRTAKRLGKWWEVFKEKQQRELRDRDRRRLPPPLDGDERGCAGGRYDWLLEDFADKLVNDHHRRMMAAPILPPWMSSSPSSSSSPSVTLSLASAAVAPAPAAPPPTWGGGGGGEVVVAELMECCREMEEGQRAWAAHRKEAAWRMKRVEMQLETERACRRREATEEFEAKMRALREEQAAAVERVEAEYREKMAGLRRDAEAKEQKMAEQWAAKHARLAKFLDQVAACRRWPPVEINGGGGGGPGGGR

SEQ ID NO: 1088 - protein, 525 aa, Oryza sativa
MEMACLPGNAMATDENGADDRAGGESTVDHLRSHMNYGDMDLSGEEHVPKARKPYTITKQREKWTDEEHRLFLEALQLHGRAWRRIQGMSHRTDRIFMAIDRNCPYSPVCRNVCVRLCVDAEHIGTKTAVQIRSHAQKFFSKVVRESSGSNTGSGGASAAAAAAAIQIPPPRPKRKPAHPYPRKVDGAAKKHVPALRQLEKPPLWMQSLSEQEEGSPTSVLTAAQIGTEALGGGFSNNSSGSGSLAPSAAGTDEHVDGGGSPASSVDREDGCLSPSIPTAELAMQAPNTKMSIATTDAKEASSEASVFRLFGKSVVVKDSDQLHLLNGSNIATSGSVERATRNILVPSFAAAPEGSSSNPWPSSMQQFLYFLPRSDGFAAQPVMPWLSYNGSLPCALFYPAAAAAANQQCHRDSEGVEFRVSQREGSLTGSNTASSVVLGSSAAVPAAAAAAQNSDVAESRGQGNSREAAASPRLTKCESSASVTLLQRGFMPYKRCAAESELLRSEAAGGEEAVADGELTRLCL

SEQ ID NO: 1089 - protein, 391 aa, Oryza sativa
MPSSGGAMPALPPGFRFHPTDEELIVHYLMNQAASVKCPVPIIAEVNIYKCNPWDLPGKALFGENEWYFFSPRDRKYPNGARPNRAAGSGYWKATGTDKSILSTPTSDNIGVKKALVFYKGKPPKGVKTDWIMHEYRLTGTSANSTTTTKQRRASSMTMRLDDWVLCRIHKKSNDFNSSDQHDQEPEESTVEQLEDIHDNNSSEQPPAPADMNNQQSDFQPMTAMSMSKSCSLTDLLNTIDCAALSQFLLDGSSDAIAEPPAPPSPLIYTTPHPNYQTLNYNINSNSSMPHAFESRLDHHDGYVNNYNVNGLRRKRMMACSATSFDDGSSSNDFVHAVVKKPQLLPSDSRGSGFGGGYCNQQLSETATGFQFQNGNLLSHPFPLNNHLQMQ

SEQ ID NO: 1090 - protein, 343 aa, Oryza sativa
MEQHQGQAGMDLPPGFRFHPTDEELITHYLAKKVADARFAALAVAEADLNKCEPWDLPSLAKMGEKEWYFFCLKDRKYPTGLRTNRATESGYWKATGKDKDIFRRKALVGMKKTLVFYTGRAPKGEKSGWVMHEYRLHGKLHAAALGFLHGKPASSKNEWVLCRVFKKSLVEVGAAGGKKAAVVTMEMARGGSTSSSVADEIAMSSVVLPPLMDMSGAGAGAVDPATTAHVTCFSNALEGQFFNPTAVHGHGGGDSSPFMASFTQYGQLHHGVSLVQLLESCNGYGGLVDMAASGSQLQPAACGGERERLSASQDTGLTSDVNPEISSSSGQKFDHEAALWGY

SEQ ID NO: 1091 - protein, 329 aa, Oryza sativa
MECGGALQLPPGFRFHPTDDELVMYYLCRKCGGLPLAAPVIAEVDLYKFNPWDLPERAMGGEKEWYFFSPRDRKYPNGQRPNRAAGTGYWKATGADKPVGSPRAVAIKKALVFYAGKPPKGVKTNWIMHEYRLADVDRSAAARKLSKSSHNALRLDDWVLCRIYNKKGVIERYDTVDAGEDVKPAAAAAAAKGGRIGGGGGAAAMKVELSDYGFYDQEPESEMLCFDRSGSADRDSMPRLHTDSSGSEHVLSPSPSPDDFPGGGDHDYAESQPSGGCGGWPGVDWAAVGDDGFVIDSSLFELPSPAAFSRAAGDGAAFGDMFTYLQKPF

SEQ ID NO: 1092 - protein, 303 aa, Oryza sativa
MSGGQDLQLPPGFRFHPTDEELVMHYLCRRCAGLPIAVPIIAEIDLYKFDPWQLPRMALYGEKEWYFFSPRDRKYPNGSRPNRAAGSGYWKATGADKPVGSPKPVAIKKALVFYAGKAPKGEKTNWIMHEYRLADVDRSARKKNSLRLDDWVLCRIYNKKGGLEKPPAAAVAAAGMVSSGGGVQRKPMVGVNAAVSSPPEQKPVVAGPAFPDLAAYYDRPSDSMPRLHADSSCSEQVLSPEFACEVQSQPKISEWERTFATVGPINPAASILDPAGSGGLGGLGGGGSDPLLQDILMYWGKPF

SEQ ID NO: 1093 - protein, 392 aa, Oryza sativa
MVLSNPAMLPPGFRFHPTDEELIVHYLRNRAASSPCPVSIIADVDIYKFDPWDLPSKENYGDREWYFFSPRDRKYPNGIRPNRAAGSGYWKATGTDKPIHSSGGAATNESVGVKKALVFYKGRPPKGTKTNWIMHEYRLAAADAHAANTYRPMKFRNTSMRLDDWVLCRIYKKSSHASPLAVPPLSDHEQDEPCALEENAPLYAPSSSSAASMILQGAAAGAFPSLHAAAAATQRTAMQKIPSISDLLNEYSLSQLFDDGGAAAAAPLQEMARQPDHHHHQQQQHALFGHPVMNHFIANNSMVQLAHLDPSSSAAASTSAGAVVEPPAVTGKRKRSSDGGEPTIQALPPAAAAAKKPNGSCVGATFQIGSALQGSSLGLSHQMLLHSNMGMN

SEQ ID NO: 1094 - protein, 220 aa, Oryza sativa
MDAMAVLARTSRPAPTLLAATSPAVSRRPAAVSFAAAASPGSRGRVALSAAWGGRAARGRVSAAGRIVASSVEQSYIMIKPDGVQRGLVGEIISRFEKKGFVLKGLKLFQCPKDLAQEHYKDLKEKPFFPGLIEYITSGPVVCMAWEGNGVVASARKLIGATNPLQAEPGTIRGDLAVQTGRNVVHGSDSPDNGKREIALWFKEGELCEWESVLTPWLVE

SEQ ID NO: 1095 - protein, 193 aa, Oryza sativa
MKPDGETQLRPTAAGHPDPGLGTSSAEYVASLGPATAPVSYPYISTYYGGTYGAYSGQPLVNAALMAMPPHSVPLVTDAVVEPIYVNARQYHGILRRRQSRAKAESENKANKIRKPYLHESRHLHALKRARGSGGRFLNSKAVEGKQDTKSVDKKDGAVPSEEKRDKKLANSIIKLENSSPTTQPGADASDVV

SEQ ID NO: 1096 - protein, 535 aa, Oryza sativa
MGMEVAAARLGALYTTSDYASVVSINLFVALLCACIVLGHLLEENRWVNESITALIIGLCTGVVILLMTKGKSSHLFVFSEDLFFIYLLPPIIFNAGFQVKKKQFFRNFMTITLFGAVGTMISFFTISIAAIAIFSRMNIGTLDVGDFLAIGAIFSATDSVCTLQVLNQDETPFLYSLVFGEGVVNDATSIVLFNALQNFDLVHIDAAVVLKFLGNFFYLFLSSTFLGVFAGLLSAYIIKKLYIGRHSTDREVALMMLMAYLSYMLAELLDLSGILTVFFCGIVMSHYTWHNVTESSRVTTKHAFATLSFIAETFLFLYVGMDALDIEKWEFASDRPGKSIGISSILLGLVLIGRAAFVFPLSFLSNLTKKAPNEKITWRQQVVIWWAGLMRGAVSIALAYNKFTRSGHTQLHGNAIMITSTITVVLFSTMVFGMMTKPLIRLLLPASGHPVTSEPSSPKSLHSPLLTSMQGSDLESTTNIVRPSSLRMLLTKPTHTVHYYWRKFDDALMRPMFGGRGFVPFSPGSPTEQSHGGR

SEQ ID NO: 1097 - protein, 577 aa, Oryza sativa
MMRCSDRLLCSLFLAAALFGVAAAATRRHDWDISYQFTSPDCVRKLAVTINGHTPGPTIRAVQGDTIVVNVKNSLLTENVAIHWHGIRQIGTPWADGTEGVTQCPILPGDTFAYTFVVDRPGTYMYHAHYGMQRSAGLNGMIVVEVAPGAAGDGEREPFRYDGEHTVLLNDWWHRSTYEQAAGLASVPMVWVGEPQSLLINGRGRFVNCSSSPATAASCNVSHPDCAPAVFAVVPGKTYRFRVASVTSLSALNFEIEGHEMTVVEADGHYVKPFVVKNLNIYSGETYSVLITADQDPNRNYWLASNVVSRKPATPTGTAVLAYYGGRRNSPRARPPTPPPAGPAWNDTAYRVRQSLATVAHPAHAVPPPPTSDRTILLLNTQNKIGGQIKWALNNVSFTLPHTPYLVAMKRGLLGAFDQRPPPETYAGAAAFDVYAVQGNPNATTSDAPYRLRFGSVVDVVLQNANMLAANSSETHPWHLHGHDFWVLGHGAGRFDPAVHPAAYNLRDPIMKNTVAVHPFGWTALRFRADNPGVWAFHCHIEAHFFMGMGIVFEEGVERVGELPPEIMGCGKTRGGH

SEQ ID NO: 1098 - protein, 522 aa, Oryza sativa
MAGGEDGADGVGDDTELRRFSDVELLEKSRRIQGELSGGIERRLKDRGAKFRRLLDAIVREIDRRKAATDDDRCARVVQSGCAESSVKQQAVTISDFRSSFGIDEEAGVDVSHLETSACIGDPKTSTDNEGILCEEEDSCKCKPSTSQKASYVDRSTYMENIDAADDGKDNGYSRICKDAHTSRKRNGEFSPTFSMRLRSRKVVEEVVLLDGDTCISDSAEKTSSACDAMKIHYPSWDTPNSIELSYSDMKCLEPESLLSSPILNFYIMYLMGQMPSTSRLGGKYHIFNTYFFSKLEALTSKVDNDAYFLNLRRWWKGVDIFKKAYIIIPVHADAHWSLVIICMPAKEDQSGPTIFHLDSLKFHSSRFIFSTVERFLKEEWNYLNKTGSLEDCHLHESVWKNLPRKIKKKAVTVPQQDNEYDCGVFVLYYMRRFIEEAPERLNNKDSSNMFGEGWFQREEASALRKEMQALLLRLFEEAKDNNHMRDPTTPVSATAEHPVEVLSTEPAVPDHPRNAVGVATS

SEQ ID NO: 1099 - protein, 502 aa, Oryza sativa
MAAMASLYRRVLPSPPAVEFASEEGKRLFSEALESGTLQGFFNLISVFQTQSEPAFCGLASLSVVLNALAIDPGRQWKGPWRWFDESMLDCCEPLDKVKAEGITFAKLACLAHCAGANVRSFRADQSTIHDFRHHLVRSASSQDCHLIASYHRKPFKQTGTGHFSPIGGYHAGQDMALILDVARFKYPPHWVPLPLLWEAMNTTDDATGLLRGFMLISRHTAAPSLLYTVSCRDESWKSMAKYCMEDVPDLLKDESVDNVPALLSRLVKSLPANAGNLIKWVIEVRRQEEGGSGLSKEEEERLILKEMILQQVRDTELFRLVRELQFTKQPCCSCSYSSDDDSFTRIAASVCCQGAALLTGNLSSKDGFCCRETCFKCVQVDGDGPKTVVTGTAVSGVNEQSVDMLLPISTLETSVCNSNSSNEVVKYPSRTDILTVLLLALHPSTWVGIKDERLKAEFQSLISTDILHDDLKREILHLRRQLHYVRSCKEEEYGDPVPQSH

SEQ ID NO: 1100 - protein, 242 aa, Oryza sativa
MAAAAAAAGSSDSRKPAAHPPPRDFLVHVEAYLSRRDGVDKLLKISRYAARLALAAGPLPPAASARLKSFESSVGLSRKAFRLGKFVQNVNALRAHPHPPPAVALLAYGGEGVYYFLEQFVWLAKAGLLPAHLLPRLQRLSAWAELLGYVGSITIKLEEIGKLESSVKMRLKEGCREESDVVRTLRVKLLLKRMSVVQDVADAVMALGDVTDGKGLLGSSTLMASAGLLSALISAHKNWNSC

SEQ ID NO: 1101 - protein, 235 aa, Oryza sativa
MRQEATCSLVLTQDAQHRKNQPPLAEEDDDRDHTDDAMPPPCSILLRQEEGEATAAAAGEGLLVPPLNFAMVDHGVYRSGFPDISNLPFVESLRLRSVLCLCPEPYPEANQEFLRAHGIRLFQFGIDGSKELGFGTENRCCLQEPFVNIPEDRIREALKVVLDVANHPVLIHCKRGKHRTGCVVGCLRKLQRWCLTSIFDEYQRFAAAKARVSDLRFMELFDISSLKHLPASFSC

SEQ ID NO: 1102 - protein, 402 aa, Oryza sativa
MATKRSVGTLGEADLRGKKVFVRADLNVPLDDAQKITDDTRIRASVPTVKFLLEKGAKVILASHLGRPKGVTPKYSLKPLVPRLSELLGVDVVMANDCIGEEVEKLAAALPEGGVLLLENVRFYKEEEKNDPEFAKKLAAVADLYVNDAFGTAHRAHASTEGVTKFLKPAVAGFLMQKELDYLVGAVANPKKPFAAIVGGSKVSTKIGVIESLLAKVDVLILGGGMIFTFYKAQGYAVGKSLVEEDKLELATSLIEKAKAKGVSLLLPTDVVVADKFAADAESKTVAASAIPDGWMGLDVGPDAIKTSSEALDTCNTIIWNGPMGVFEFEKFAAGTDAIAKKLADLTTTKGATTIIGGGDSVAAVEKAGLADKMSHISTGGGASLELLEGKTLPGVLALDEA

SEQ ID NO: 1103 - protein, 575 aa, Oryza sativa
MPNPSSLLASPSPPHRNSSSSSSISIISTPATIQPDAAHGPCSLLTTSKYALRDTRGSKSSYTRLCCCCTAAPKAEQEEETLQQELLLFGLVQVGELLEEGGIARLGSSALLSFYFLFFFLFVPRFLASLCGLSCWFSFYFKVVNFLGGHKNRGMDGNARSAANQTKQIVTDNELVELLWHNGGVVAQPQAAQARVVSSSGRGQSASVLTGDDTETAAWFPDTLDDALEKDLYTQLWRSVTGDAFPAAAAAGPSSHHAPPPDLPPPAARPPMRSGIGSSWTGDICSAFCGSNHIPETAAQRCRDAGAALPPERPRRSSTHDGAGTSSSGGSGSNFGASGLPSESASAHKRKGREDSDSRSEDAECEATEETKSSSRRYGSKRRTRAAEVHNLSERRRRDRINEKMRALQELIPHCNKTDKASILDEAIEYLKSLQMQVQIMWMTTGMAPMMFPGAHQFMPPMAVGMNSACMPAAQGLSHMSRLPYMNHSMPNHIPLNSSPAMNPMNVANQMQNIQLREASNPFLHPDGWQTVPPQVSGPYASGPQVAQQNQIPKASASTVLPNSGAEQPPTSDGI

SEQ ID NO: 1104 - protein, 288 aa, Oryza sativa
MEGKEEDVRLGANRYTERQPIGTAAQGAEEKDYREPPAAPVFEVEELTSWSFYRAGIAEFVATFLFLYISILTVMGVNKSASKCATVGIQGIAWSFGGMIFALVYCTAGISGGHINPAVTFGLFLARKLSLTRAVFYMAMQCLGAICGAGVVKGFQRGLYMGSGGGANAVNPGYTKGDGLGAEIVGTFVLVYTVFSATDAKRNARDSHVPILAPLPIGFAVFLVHLATIPITGTGINPARSLGAAIVYNRAHAWHDHWIFWVGPFIGAALAAIYHVVVIRAIPFKSRD

SEQ ID NO: 1105 - protein, 358 aa, Oryza sativa
MSMAEVCCDSAVVVGAEAEARARARAGRRRRAGVEGAGRWNATATAAGVAAEEAATRKRRASGGEAGLVVVAKRHGAASVAGRRREMEDAVSLREAFAAPANGEVAAARCDFYGVFDGHGCSHVADACRERMHELVAEEMGAGSPAAAAREPASWTETMERSFARMDAEVIAGCRAESGSCRCEGQKCDHVGSTAVVAVVEESRVVVANCGDSRAVLCRGGAPVQLSSDHKPDRPDELERIEAAGGRVIFWEGARVLGVLAMSRSIGDAYLKPYVTAVPEVTVTGRSDFDECLILASDGLWDVVSNEAACEVAQSCLRRGRQRWCAEAAAVLTKLALARRSSDNISVVVVDLRRGNAL

SEQ ID NO: 1106 - protein, 220 aa, Oryza sativa
MKSIYASHLQPWNGIKTQILHAGKFHNARLSHPYIYGPKVWCILPSATEKDCATVQTTSFSIRCTIEETKILKVMAGITGSRALMVVALLCAAAAMTAAQEASNVRATYHYYNPQQNNWDLNKVSAYCATWDANKPLSWRQKYGWTAFCGPAGPRGRDSCGKCIQVKNRGTGATIIARIVDQCSNGGLDLDYETIFKKIDTDGRGYQMGHLQVDYKFVNC

SEQ ID NO: 1107 - protein, 271 aa, Oryza sativa
MGALPRALVLGVCAAVLLVNVLAVAADGDAAAAASMVVGLAKCADCTRKNMKAEAVFKGVRVAIKCKNSNGEYETKATGEVGKSGAFAVPLAADLLGDDGELRQQCFAQLHSAASNQPCPGQEPSWIVNAAADKKKTFVAVAGDTHFPSSECASAFLCDPFHKKDFFFHYKNPSPPAPAAYHKPPPSYTHPAPPVYSYPTPAYSHPTPVYKQPLPTPSPPIYHPPAEEKKVAMQDDAEADPELFKKLLPLIKKNPFLKFPKLPPVEVEAKP

SEQ ID NO: 1108 - protein, 137 aa, Oryza sativa
MAASVMASLALKPSASPLLERSKLRGKGTMARPSLIIVAKKAKKIQTSQPYGPAGGVVFKEGVDASGRVAKGKGLYQFSNKYGANVDGYSPIYTPEEWSSTGDVYVGGKAGLLLWAITLAGILVGGAILVYNTSALA

SEQ ID NO: 1109 - protein, 824 aa, Oryza sativa
MENFSPRTLLNSILRITVLTSDGSTARPKPIQKYCQNVCDISSIVSPLIEDLCESPEEQLNEVLRELGTAINRASGLIGNWQQTTSKIYFIWQIESVISDIQGCSLQLCQLVNSLLPSLTGRACTCIEKLQDINYENMFDLVKESSLELVETDTTSPENLSRLSSSLSLSTNLEFYMEAVSLENLRARAMRSENREEMDLADKMIPLVNYMHDHLLRETQLLSINGVPIPADFCCPLSLELMSDPVIVASGQTYERVYIKLWLDEGFTICPKTRQRLGHSNLIPNYTVKALIANWCESHNIRLPDPMKSLKLNFPLAASALQDSSTTGSSPLHPTVAAKGNIPGSPEADLYMRSLNRASPPHSVVHQNSHAHVNRAGHEASIKQSSENANGSASDVSRLSLAGSETRESSLEERNAGSIGQTSEQSIEEAFQASNLDRDSHDHVGSSSVNGSLPNSGQLDAECDNGPSERTNYSSDASGEVTDGPSASSAPQREHLIPSRLADVRSRGQFVRRPSERGFPRIISSSSMDTRSDLSAIENQVRKLVDDLRSDSVDVQRSATSDIRLLAKHNMENRIIIANCGAINLLVGLLHSPDSKTQEHAVTALLNLSINDNNKIAIANADAVDPLIHVLETGNPEAKENSAATLFSLSVIEENKVRIGRSGAIKPLVDLLGNGTPRGKKDAATALFNLSILHENKARIVQADAVKYLVELMDPAAGMVDKAVAVLANLATIPEGRTAIGQARGIPALVEVVELGSARGKENAAAALLQLCTNSSRFCSIVLQEGAVPPLVALSQSGTPRAREKAQALLSYFRSQRHGNSARR

SEQ ID NO: 1110 - protein, 204 aa, Oryza sativa
MVEVGGGAAEAAAGRRWRLADERCDLRAAETEYVRRFHRHEPRDHQCSSAVAKHIKAPVHLVWSLVRRFDQPQLFKPFVSRCEMKGNIEIGSVREVNVKSGLPATRSTERLELLDDNEHILSVRFVGGDHRLKNYSSILTVHPEVIDGRPGTLVIESFVVDVPEGNTKDETCYFVEALLKCNLKSLAEVSERLVVKDQTEPLDR

SEQ ID NO: 1111 - protein, 206 aa, Oryza sativa
MASRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLNNWREEFLIQASPSDPDNFPFVLLGNKVDVDGGNSRVVSEKKAKAWCASKGNIPYFETSAKDGTNVEEAFQCIVKNALKNEPEEELYVPDTVDVVGGNRAQRSSGCC

SEQ ID NO: 1112 - protein, 197 aa, Oryza sativa
MSASRFIKCVTVGDGAVGKTCMLISYTSNTFPTDYVPTVFDNFSANVVVDGNTVNLGLWDTAGQEDYNRLRPLSYRGADVFLLAFSLISKASYENVSKKWIPELKHYAPGVPIILVGTKLDLRDDKQFFVDHPGAVPITTAQGEELRKQIGAPYYIECSSKTQLNVKGVFDAAIKVVLQPPKAKKKKKAQRGACSIL

SEQ ID NO: 1113 - protein, 221 aa, Oryza sativa
MALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQYYEVSAKSNYNFEKPFLYLARKLAGDGNLHFVETPALAPPDVTIDLAAQQQHEAELAAAAAQPLPDDDDDLIE

SEQ ID NO: 1114 - protein, 221 aa, Oryza sativa
MALPNQGTVDYPSFKLVIVGDGGTGKTTFVKRHLTGEFEKKYEPTIGVEVHPLDFTTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQYYEISAKSNYNFEKPFLYLARKLAGDPNLHFVEAVALKPPEVPIDLAMQQQHEAELAAAAAQPLPDDDDDLIE

SEQ ID NO: 1115 - protein, 943 aa, Oryza sativa
MRGGASSGPQRWGSAGTTPRSLSTGSSPRGSDDRSSDDGEELVEVTLDLQDDDTIVLRSVEPAAAAAAGVGAGAGAASARGELTGGPSSSSSRSRSPSIRRSSSHRLLQFSQELKAEAMARARQFSQDLTKRFGRSHSRSEAQAPSGLESALAARAARRQRAQLDRTRSGAHKALRGLRFISSNKANNAWMEVQANFDRLARDGYLSRSDFAECIGMTESKEFALELFDTLSRRRQMKVDTINKDELREIWQQITDNSFDSRLQIFFEMVDKNADGRITEAEVKEIIMLSASANKLSRLKEQAEEYAALIMEELDPEGLGYIELWQLETLLLQKDTYMNYSQALSYTSQALSQNLAGLRKKSSIRKISTSLSYYFEDNWKRLWVLALWIGIMAGLFTWKFMQYRNRYVFDVMGYCVTTAKGAAETLKLNMAIILLPVCRNTITWLRSTRAARALPFDDNINFHKTIAAAIVVGIILHAGNHLVCDFPRLIKSSDEKYAPLGQYFGEIKPTYFTLVKGVEGITGVIMVVCMIIAFTLATRWFRRSLVKLPRPFDKLTGFNAFWYSHHLFIIVYIALIVHGECLYLIHVWYRRTTWMYLSVPVCLYVGERILRFFRSGSYSVRLLKVAIYPGNVLTLQMSKPPTFRYKSGQYMFVQCPAVSPFEWHPFSITSAPGDDYLSIHVRQLGDWTRELKRVFAAACEPPAGGKSGLLRADETTKKILPKLLIDGPYGSPAQDYSKYDVLLLVGLGIGATPFISILKDLLNNIIKMEEEEDASTDLYPPMGRNKPHVDLGTLMTITSRPKKILKTTNAYFYWVTREQGSFDWFKGVMNEIADLDQRNIIEMHNYLTSVYEEGDARSALITMLQALNHAKNGVDIVSGTKVRTHFARPNWRKVLSKISSKHPYAKIGVFYCGAPVLAQELSKLCHEFNGKCTTKFEFHKEHF

SEQ ID NO: 1116 - protein, 253 aa, Oryza sativa
MDQIYMAAVNNKTSLPDDEPMKKISGDMPVTAGNACFDCNICLDFAAEPVVTLCGHLYCWPCIYEWLCPGVGSTASNNSSLARRQCPVCKATLSPDMLVPLYGRGGSLKKSLNGVPIPRRPTVQREAVEHQNTHNNIDDRHHENMEPSPPPQPLRHSSHHSSATEFDFIYPPSPIGRGLIHSTAGGVLGGMAVAVLPWAFRGQVPPSMFMSPHYVTAHNMSSRARRHQMEVERSLHQIWFFLFVFVVLCLLLF

SEQ ID NO: 1117 - protein, 510 aa, Oryza sativa
MFIESFRVESPHVRYGAAEIESDYQYDTTELVHESHDGASRWIVRPKSVRYNFRTTTTVPKLGVMLVGWGGNNGSTLTAGVIANREGISWATKDKVQQANYYGSLTQASTIRVGSYNGEEIYAPFKSLLPMVNPDDLVFGGWDISNMNLADAMTRAKVLDIDLQKQLRPYMESMVPLPGIYDPDFIAANQGSRANNVIKGTKKEQMEQIIKDIREFKEKSKVDKVVVLWTANTERYSNVCVGLNDTMENLLASVDKNEAEISPSTLYAIACVMEGIPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYELGEHPDHVVVIKYVPYVGDSKRAMDEYTSEIFMGGKSTIVLHNTCEDSLLAAPIILDLVLLAELSTRIQLKAEGEEKFHSFHPVATILSYLTKAPLVPPGTPVVNALAKQRAMLENIMRACVGLAPENNMILEYK

SEQ ID NO: 1118 - protein, 298 aa, Oryza sativa
MVKPAAVLLLLYLPLLATPTRIGLSRNPFVPPPNSVPTIDRTEMDVSTSPYRDLIKKWRDLVLLNTRPEVMVPEDHPVLAPQYDDTVPPERLLLPKLVANGDKTATLALRDSNIYFIGFANKAGQWFSFKDRNDLPPSFRARPLSFGVDYASIAGFRKNLPNYPLGRRQTEWAVKVLSEYDPNRTDEATIKRAVVIILLTFCEALRFFPIRNAVEIGWDSVAYITSTDADRLVCWGQISYMLEYSFMSGHSWDSEEQRTRLKNLARDCKIFNEPQALETVDVLEYGAILGAKSTNWLY

SEQ ID NO: 1119 - protein, 308 aa, Oryza sativa
MAEKEVGRIFVGGLSWDTTERTLERAFSEYGKVIETQVVLERDTGRSRGFGFVTFSEPRAVDAAIRGMHNGELDGRTISVNKAQPRMNTDDGYGYGGGGGGGGTYSSGARGGYRGGGDAVPSANDDCFKCGRAGHWARECPYSSGGGGGRTGRYSPPSRYGSGTGGGRGDRFGGSDRFANRYVDDRYDGGRYVDDRYGGGGRDRYATDRYPPTADRFTGDRYGGSDRYASSGFTRERSYERDGGRSGGSYYRDEPRGSGGYDRGGMRMGSGDRYGTGGPARFAGSYRDRPAPYDRPSRAAARTYDDRY

SEQ ID NO: 1120 - protein, 302 aa, Oryza sativa
MGAMDVQLESTAVQHGQAKINVEEHALVSLLSDEKYATEKTEDVDPDDYEKLEEGIMQYGCAHYRRRCRIRAPCCNEIFDCRHCHNETKNSIKIDAVKRHELPRHEVQQVICSLCGTEQEVRQVCISCGVCMGKYFCEVCKLFDDDVSKQQYHCNGCGICRIGGKENFFHCSKCGCCYSIVLKNSHACVEGAMHHDCPICFEYLFESTNDVSVLPCGHTIHVKCLREMEEHCQFACPLCSKSVCDMSKAWERLDEELATISDTCDNKMVRILCNDCGATSEVQFHLIAHKCQKCKSYNTRQI

SEQ ID NO: 1121 - protein, 160 aa, Oryza sativa
MSGGIARGRLAEERKAWRKNHPHGFVAKPETMADGSANLMIWHCTIPGKQGTDWEGGYYPLTLHFSEDYPSKPPKCKFPQGFFHPNVYPSGTVCLSILNEDSGWRPAITVKQILVGIQDLLDQPNPADPAQTDGYHIFIQDKPEYKRRVRVQAKQYPALL

SEQ ID NO: 1122 - protein, 168 aa, Oryza sativa
MASSSSRLSCCLLVLAAAAMAATAQNSAQDFVDPHNAARADVGVGPVSWDDTVAAYAESYAAQRQGDCKLEHSDSGGKYGENIFWGSAGGDWTAASAVSAWVSEKQWYDHGSNSCSAPEGSSCGHYTQVVWRDSTAIGCARVVCDGDLGVFITCNYSPPGNFVGQSPY

SEQ ID NO: 1123 - protein, 282 aa, Oryza sativa
MSFVFRGSRGDIEAGGFPGFAPERRAMRIHAGGRPVNSNLAFLVTVLMLFMVLNSHQMSPNFLVWLVLGVFLMATSLRMYATCQQLQAQAQAHAAAANGFLGHTELRVHVPPTIALATRGRLQSLRLQLALLDREFDDLDYDALRALDADNSPHAPSMSEEEINALPVFKYKVQAHQGSASFRKSDGPSQPSVSSTESGNEKKQDRFKADATDNTLEDELTCSVCLEQVVVGDLLRSLPCLHQVWFECLTVMVFDVEPWPLHKIRDLCLVWLLNLVFKFVPV

SEQ ID NO: 1124 - protein, 255 aa, Oryza sativa
MPPSAAAAAAMAQSPRSLHTLISFGRGADGVDDDEATPASVDVGDAEGAGLDLDFAFAPPVSAAELAPADDIFAHGRIVPAYPVFDRSLLDLSPGDASTAAPSADTYCAWTPRSAPGSPGRDRFPKSASTGGESSSSSRRWRLRDLVGAGGRSRSDGKDKFAFLHHHAAAPPSSKLKTPPPPQQPQQKKQSAVKTKPAAKKGVVTEMDMATAHRLFYSKASAGGDRRPQQASYLTYRPAFSGLFALGRSQHHTAY

SEQ ID NO: 1125 - protein, 317 aa, Oryza sativa
MGSGNLMMKKVVRPSSFDFDIQLDKSWTEDVTCPICLDYPHNAVLLRCTSYEKGCRPFVCDTDQTRSNCLERFKGAYELPANMKVSTIAVAPLDSIHIVAPNVNNRPSCPLCRGDVIGWIVIGEARLHLNQKKRCCEEDCCSFVGNFNELQKHTQQKHPDSRPSEIDPARQVDWENFQQSSDIVDVLSTIHAQVPNGIVLGDYVIEYGDDETGEEYEVFRRVRRHWWSFMFFRGFSRSSRRRRRARARERRGSGRRNSNQAHLESFNLEVPTQSVDLREIRFDEIDDEYIVTGAIPSIATPGRMASFHYRSVETVYC

SEQ ID NO: 1126 - protein, 980 aa, Oryza sativa
MAAARAPWLWWWVVVVVGVAVAEAASGGGGGGDGEGKALMGVKAGFGNAANALVDWDGGADHCAWRGVTCDNASFAVLALNLSNLNLGGEISPAIGELKNLQFVDLKGNKLTGQIPDEIGDCISLKYLDLSGNLLYGDIPFSISKLKQLEELILKNNQLTGPIPSTLSQIPNLKTLDLAQNQLTGDIPRLIYWNEVLQYLGLRGNSLTGTLSPDMCQLTGLWYFDVRGNNLTGTIPESIGNCTSFEILDISYNQISGEIPYNIGFLQVATLSLQGNRLTGKIPDVIGLMQALAVLDLSENELVGPIPSILGNLSYTGKLYLHGNKLTGVIPPELGNMSKLSYLQLNDNELVGTIPAELGKLEELFELNLANNNLQGPIPANISSCTALNKFNVYGNKLNGSIPAGFQKLESLTYLNLSSNNFKGNIPSELGHIINLDTLDLSYNEFSGPVPATIGDLEHLLELNLSKNHLDGPVPAEFGNLRSVQVIDMSNNNLSGSLPEELGQLQNLDSLILNNNNLVGEIPAQLANCFSLNNLNLSYNNLSGHVPMAKNFSKFPMESFLGNPLLHVYCQDSSCGHSHGQRVNISKTAIACIILGFIILLCVLLLAIYKTNQPQPLVKGSDKPVQGPPKLVVLQMDMAIHTYEDIMRLTENLSEKYIIGYGASSTVYKCELKSGKAIAVKRLYSQYNHSLREFETELETIGSIRHRNLVSLHGFSLSPHGNLLFYDYMENGSLWDLLHGPSKKVKLNWDTRLRIAVGAAQGLAYLHHDCNPRIIHRDVKSSNILLDENFEAHLSDFGIAKCVPSAKSHASTYVLGTIGYIDPEYARTSRLNEKSDVYSFGIVLLELLTGKKAVDNESNLHQLILSKADDNTVMEAVDSEVSVTCTDMGLVRKAFQLALLCTKRHPSDRPTMHEVARVLLSLLPASAMTTPKTVDYSRLLASTTTAADMRGHDVTDIGDNSSSDEQWFVRFGEVISKHTM

SEQ ID NO: 1127 - protein, 837 aa, Oryza sativa
MPPPLYVLLLLSGLLLSSLHTPPCSAAIADGDTLMVGQALSVGEKLVSRNGKFALGFFQPQPTAGISKSINTTTNTLPGWYLGIWFNKIQVFTTAWVANRENPITGPELKQAQLKISRDGNLAIVLNNNNTSSESIIWSSTHTIVNRTTGSSSTNTSALLMNNGNLLLMASSNVVLWQSFDYPADVGLPGAKLGRNKITGLNRRFVAKKSLIDMGLGSYILEMDTNTVLRLRRRKPPVVVYWSWSSGQLAYTLVPLLNELLDMDPRTKGLLKPAYVHNNEEEYFTYTSLDESASVFVSIDITGQVKLNVWSQPKMSWQTIYAEPSDPCSLHDVCGPFTVCNGNSVPFCGCMESFSPKSPQDWDAGDPIGGCIRDTPLDCASGKQNNTSSTDMFHPIAPVTLPLYPQSMEDASTQSDCEEACLHDCACTAYTYNGNRCSIWHGELRSVNQNDGIDNHSENVLYLRLAARDSQSLRKNNKRRPRVVAIVSIVVSFGLLMLMLLLTIWINKSKWCGVPLYGSQGNDGGIIAFRYTGLVRATKCFSEKLGGGGFGSVFKGMLGDQTAIAVKRLDGARQGEKQFRAEVSSIGMTQHINLIKLIGFCCEGDKRLLVYERMLNGSLDAHLFQSNATVLNWSTRYQIAIGVARGLCYLHQSCRECIIHCDIKPENILLNESFVPKIADFGMAAIVGRDFSRVLTTFRGTVGYLAPEWLSGVAITPKVDVYSFGMVLLEIISGRRNSPKVSASNSYHGAYFPVRAINKLHVGDVHSLMDPRLHDDFSLEEAERVCKVACWCIQEIESDRPTMGEVVRAIEGLHELDMPPMPRLLAAIIEHSDVASI

SEQ ID NO: 1128 - protein, 674 aa, Oryza sativa
MRRPELIMRSLPLILFLSLGSFHLAAAAVDDQFTFDGFAGVNLTLDGTAVVTPGGLLMLTNGTTLLKGHAFYPSPLRFFHEATSGGGSSTVRSFSTAFVFGIVSEYADLSSPGLAFVVAKSRDFSSALQSQYMGLANARNNGNASNHFLAVELDTIVNAEFGDMSDNHVGIDVDGLASAAADDAGYHDDRTGAFVNMSLLSRAAARVWVDFDARTSLVNVTMAPLELPKPTTPLLSAAVNLSAVIEDEAYVGFSSSTGVVASRHYVLAWSFKMDGPAPSLNVSKLPALPVTIARAPSNVLKILLPIASAALVSALAIAVLVIHRRRRRYAELKEEWEVAFGPHRFSYKDLFRATNGFSDERLLGFGGFGRVYKGVLLVSRVEIAVKKVSHESRQGMKEFIAEVVSIGQLRHRNLVQLLGYCRQKGELLLVYDYMPNGSLDKYLYAENSKILSWAQRFRIIKGIASSILYLHEDWEQVVLHRDIKASNVLLDAEMNCRLGDFGLARLYDRGTDPHTTHVVGTIGYLAPELGHTGRPSKASDIFAFGVFMLEVTCGRRPVLQDTNGGQLLLVDMVLEHWRQGTVTDAVDPRLQGDFAVEEASLVLKLCLLCSHPLPSARPGIRQVVQLLDGAMPLPELSQAHLSCNMLALMQNQMGNSCSVASSVAGNISDIPRAR

SEQ ID NO: 1129 - protein, 876 aa, Oryza sativa
MADLVSSCKDKLAYFRIKELKDILNQLGLPKQGKKQDLIDRVLALLTDEQGQRHHGWGRKNSLTKEAVAKIVDDTYSRKMQIQCAPDLATRSHSGSDFSFRPIEEAYDSFQPEAKVRCICSSTMVNDSMIQCEDQRCQVWQHLNCVLIPDKPGESAEVPPVFYCELCRLSRADPFWVTAGNPLLPVKFVSSGVTNDGTSVPQSVEKSFQLSRSDRETVQRQEYDLQVWCMLLNDKVQFRMQWPQYAELHVNGISVRVVTRPGSQLLGINGRDDGPLITTCSREGINKICLSRVDARTFCFGVRIAKRRTVAQVLNLVPKEAEGESFEHALARVRRCLGGGDTAENADSDSDLEVVAESVTVNLRCPNSGSRMRIAGRFKPCIHMGCFDLETFVELNQRSRKWQCPICLKNYSLESLMIDPYFNRITSLLRNCNEDVNEVDVKPDGSWRVKGDAASRELSQWHMPDGTLCNPKEDVKPAMQNGNEQMMEGTSDGQKSLKIGIKRNPNGIWEVSSKADDKKPSVVGNRMQNNSGFRALNNIMHMSNSPTSSYRDGEDPSVNQESNRHVDLSLNNGNNEFDSFSLNFGQACNTDDRPQQQHNATDVIVLSDSDEENDAMVCPPAVYDNTTTANGSGFPFTTNGIGYTERYQEDAGVGTSGLGLLSNNVDDFEMNNWQMHSSYQQPEQGFQFFGNDTDVHNTFVGSHNSFGLAPNDYSLDCNVGVEEASVTPALSVCRNSNEMHGSLVDNPLALVGDDPSLQIFLPSQPSSVPLQEELSERANAPNGVQSDDWISLTLAAGGGGNEEPAPADVNSQPQIPSTETGIEPLTDAASAFLSTNIERRSGADLNPRRIENIFSHPRQPRSVRPRLCLSIDTDSE

SEQ ID NO: 1130 - protein, 163 aa, Oryza sativa
MDGLVGLLKIRVVRGINLAYRDTRGSDPYVVLRLGKQKVKTSVKKKSVNPIWHEELTLSIMNPIAPIKLGVFDKDTFSRDDPMGDAEIDLEPFMEVLNMDPENIRNGSIIKTIRPSNQNCLADESHLFWRNGKFVQDIILRLRNVESGELQVQLQWVKIPGRH

SEQ ID NO: 1131 - protein, 316 aa, Oryza sativa
MGMGMRRERDAEAELNLPPGFRFHPTDDELVEHYLCRKAAGQRLPVPIIAEVDLYKFDPWDLPERALFGAREWYFFTPRDRKYPNGSRPNRAAGNGYWKATGADKPVAPRGRTLGIKKALVFYAGKAPRGVKTDWIMHEYRLADAGRAAAGAKKGSLRLDDWVLCRLYNKKNEWEKMQQGKEVKEEASDMVTSQSHSHTHSWGETRTPESEIVDNDPFPELDSFPAFQPAPPPATAMMVPKKESMDDATAAAAAAATIPRNNSSLFVDLSYDDIQGMYSGLDMLPPGDDFYSSLFASPRVKGTTPRAGAGMGMVPF

SEQ ID NO: 1132 - protein, 295 aa, Oryza sativa
MKFGKSLSSQIVETLPEWRDKFLSYKDLKKRLKLIGGGGGGEERQAKRARVAADGGEEEAAAAAMTPEEAGFMRLLEAELDKFNSFFVEKEEEYIIRQKELQDRVARAAGRESKEELMRVRKEIVDFHGEMVLLENYSALNYTGLVKILKKYDKRTGALIRLPFIQKVLQQPFFTTDLLYKLVKQCEAMLDQLLPSNELSVSSEDGRGDSTNEDKPSNPSSSLVNGGTIPELDEIEYMESMYMKGTVAALRSLKEIRSGSSTVSAFSLPPLQGDSSPEEQQELWNKIPVIEQAAK

SEQ ID NO: 1133 - protein, 260 aa, Oryza sativa
MELDDASRHGFGRMGFGCKHYRRRCRIRAPCCNDVFHCRHCHNESTKDGHELDRHAVESVICLVCDTEQPVAQVCYNCGVCMGEYFCSACKFFDDDVDREHFHCQDCGICRVGGKDNFFHCEKCGSCYSVSLRDKHCCIENSMKNNCPICYEYLFDSLRETSVLRCGHTMHLQCFHEMLKHDKFSCPICSMPIFDMDKFLRALDAEIEANMLHIDYMGKGWIVCNDCRDTTQVYARVAGHKCCHCQSHNTCRVAAPVLPA

SEQ ID NO: 1134 - protein, 344 aa, Oryza sativa
MDFSGDIDDLISLQLLHDQLLGVEADACLPVAVHHDGVAAFAEHQQGFHPAAFLPQQPMTMTPAGYVDMANDQYLGAHAAAGEAEAVYRAAAAEPVMIRFGGEVSPVSDPRRPPLTISLPPTSHAWAAAEAVHPAALLQAQTAAAAADPNDFRKYRGVRQRPWGKFAAEIRDPKKRGSRVWLGTYDTAIEAARAYDRAAFRMRGAKAILNFPNEVGSRGADFLAPPPPPPPPTTSTHGKRKRHETAAADPDVEVIGESSKSVKTETYTSPASSSLASTTTSTVTSSSTSPSPSSEAAACGGGGGELFVPPMPSSWSWDQLEGFFGILSPLSPHPQMGFPEVAVN

SEQ ID NO: 1135 - protein, 579 aa, Oryza sativa
MAVAAALLRRRALYSALASPSWLHDTSSCYICSISGTHSLVNHPNLRLQRGYHNSGKFDLTDLTHPHIWYPNAREKKRNVFLHVGPTNSGKTHNALKRLEASSSGVYCGPLRLLAREVAQRLNKANVPCNLITGQEREEIEGAKHSSVTVEMADMTTEYQCAVIDEIQMVGCRSRGFSFTRALLGLCSDELHVCGDPAVVPLIQRILEPTGDVVTVQYYERLSPLVPLKTTLGSFSNIKAGDCVVTFSRRSIYMLKRRIEMGGKHLCSVVYGSLPPETRTKQATMFNDQDSNLNVLVASDAIGMGLNLNISRIIFSTLEKFDGICNRELTVAEIKQIAGRAGRYGSKFPVGEVTCLNSDHLPLLHSALKSPSPIIERAGLFPTFDVLSLYSRLHGTDFFQPILERFLDKAKLSPDYFIADCEDMLKVAAIVDELPLGLYDKYLFCLSPVDIRDDISTKGLIQFAENYAKKGIVRLKEIFTPGTLQVPKSHNQLKELESIHKVLELYVWLSFRLEDSYPDRELAASQKSICSMLIEEYLERSGWQQNGRKDFLQKPKRLHQEYDASQLRKYFQEIDVRSK

SEQ ID NO: 1136 - protein, 187 aa, Oryza sativa
MAMEGKSRRFAVACGVLSQYVRAEQKMAAAAGAAPARAVTTLSLMPGAEVVVEEEERREVGEEEAGPATAPAAPLTIFYGGRMVVFEDFPADKAAEVMRMASSGMAAAPAQREGAALADMPIMRKASLQRFFAKRKDRLAATTPYARPSPAETKASEPEEKKTPTSWLDLAASASAAARRDSLTIAL

SEQ ID NO: 1137 - protein, 381 aa, Oryza sativa
MAGREKRRRVAALDGEERRRRQEEAATLLHRIRGLVRWVVAEVAAGRSPTVALHRYQNYCSSASAAAASPCACSYDVPVGTDVLSLLHRGSHASRLNVLLRVLLVVQQLLQQNKHCSKRDIYYMYPSIFQEQAVVDRAINDICVLFKCSRHNLNVVPVAKGLVMGWIRFLEGEKEVYCVTNVNAAFSIPVSIEAIKDVVSVADYILIVEKETVFQRLANDKFCERNRCIVITGRGYPDIPTRRFLRYLVEQLHLPVYCLVDADPYGFDILATYKFGSLQLAYDANFLRVPDIRWLGVFTSDFEDYRLPDCCLLHLSSEDRRKAEGILSRCYLHREAPQWRLELEAMLQKGVKFEIEALSACSISFLSEEYIPKKIKQGRHI

SEQ ID NO: 1138 - protein, 371 aa, Oryza sativa
MDLSNSSPVITDPVAISQQLLGGLPSNLMQFSVMPGGYSSSGMNVGVSRLKIEEVLVNGLLDAMKSSSPRRRLNVAFGEDNSSEEEDPAYSAWMAKCPSALASFKQIVASAQGKKIAVFLDYDGTLSPIVDDPDKAVMSPVMRAAVRNVAKYFPTAIVSGRSRNKVFEFVKLKELYYAGSHGMDIMAPSANHEHSAEKSKQANLFQPAHDFLPMIDEVTKSLLQVVSGIEGATVENNKFCVSVHYRNVAEKDWKLVARLVNEVLEAFPRLKVTNGRMVLEVRPVIDWDKGKAVEFLLQSLGLNDSENVIPIYIGDDRTDEDAFKVLRQRNCGYGILVSQVPKETEAFYSLRDPSEVMEFLNFLVRWKKHSV

SEQ ID NO: 1139 - protein, 980 aa, Oryza sativa
MPTPAPSASSSSSSCGGGGGGAGAASSYSSSPDDRMLRGECGRRHPFASSAAVGAGSPDAMDTDSAEPSSAATSVADFGARSPFSPGAASPANMDDAGGASAAGHAARPPLAGPRSGFRRLGLRGMKQRLLVVANRLPVSANRRGEDQWSLEISAGGLVSALLGVKDVDAKWIGWAGVNVPDEVGQRALTRALAEKRCIPVFLDEEIVHQYYNGYCNNILWPLFHYLGLPQEDRLATTRNFESQFNAYKRANQMFADVVYQHYKEGDVIWCHDYHLMFLPKCLKDHDINMKVGWFLHTPFPSSEIYRTLPSRSELLRSVLCADLVGFHTYDYARHFVSACTRILGLEGTPEGVEDQGRLTRVAAFPIGIDSERFKRALELPAVKRHITELTQRFDGRKVMLGVDRLDMIKGIPQKILAFEKFLEENHEWNDKVVLLQIAVPTRTDVPEYQKLTSQVHEIVGRINGRFGTLTAVPIHHLDRSLDFHALCALYAVTDVALVTSLRDGMNLVSYEYVACQGSKKGVLILSEFAGAAQSLGAGAILVNPWNITEVADSIKHALTMSSDEREKRHRHNYAHVTTHTAQDWAETFVCELNETVAEAQLRTRQVPPDLPSQAAIQQYLHSKNRLLILGFNSTLTEPVESSGRRGGDQIKEMELKLHPELKGPLRALCEDEHTTVIVLSGSDRSVLDENFGEFNMWLAAEHGMFLRPTNGEWMTTMPEHLNMDWVDSVKNVFEYFTERTPRSHFEHRETSFVWNYKYADVEFGRLQARDMLQHLWTGPISNAAVDVVQGSRSVEVRSVGVTKGAAIDRILGEIVHSKSMITPIDYVLCIGHFLGKDEDIYVFFDPEYPSESKVKPDSSGSVSLDRRPNGRPSNGRSNSRNSQSRTPKAQAAPERSSSSSSSSQGTPNSHHDWREGSSVLDLKGENYFSCAVGRKRSNARYLLNSSEEVVSFLKEMADATAAHNGFQSTTADYMFLDRQ

SEQ ID NO: 1140 - protein, 402 aa, Oryza sativa
MMMMGEGAHAPPWQQHVASPVSGVEGGGGRESEVVAAPYHLLDTLRHYLPSNEAAAAEDEEEAAAVAAAVDAYACDEFRMYEFKVRRCARGRSHDWTECPFAHPGEKARRRDPRRYCYSGTACPDFRKGGCKRGDACEFAHGVFECWLHPARYRTQPCKDGTACRRRVCFFAHTPDQLRVLPPSQQQGSNSPRGCGGGGAGAAASPLAESYDGSPLRRQAFESYLTKSIMSSSPTSTLVSPPRSPPSESPPLSPDAAGALRRGAWAGVGSPVNDVHVSLRQLRLGSPRSAPSCASFLPAGYQYGSPKSPAAAAAAALYSLPSTPTRLSPVTVTTASGATVTVEPLDLGLIEEEQPMERVESGRALREKVFERLSKEATVSTDAAAAAAGVAPDVGWVSDLIN

SEQ ID NO: 1141 - protein, 496 aa, Oryza sativa
MAARWCFALLLALSAAAAGAGAKRTWEPVIRMPGEVVEEEVATVPRGSEGTEEEEKDGVGTRWAVLVAGSSGYGNYRHQADVCHAYQILRKGGLKEENIVVFMYDDIANNILNPRPGVIVNHPQGEDVYAGVPKDYTGDEVTAKNFYAVLLGNKTAVTGGSRKVIDSKPNDHIFIFYSDHGGPGVLGMPNLPYLYAADFMKVLQEKHASNTYAKMVIYVEACESGSIFEGLMPEDLNIYVTTASNAEESSWGTYCPGMEPSPPSEYITCLGDLYSVSWMEDSETHNLKEESIKKQYEVVKKRTSDMNSYGAGSHVMEYGDRTFKDDKLYLYQGFDPANAEVKNKLSWEGPKAAVNQRDADLLFLWRRYELLHDKSEEKLKALREISDTVMHRKLLDSSVDLVGKLLFGFGNGPSVLQAVRPSGQPLVDDWDCLKRMVRIFESHCGPLTQYGMKHMRAFANICNNGISGASMKEASIATCSSHNSGRWSSLVQGYSA

SEQ ID NO: 1142 - protein, 361 aa, Oryza sativa; identical to SEQ ID NO: 1077

SEQ ID NO: 1143 - protein, 470 aa, Oryza sativa
MDLAAAAVAVSFPRPAPPPRRCAPRRHRRALAPRAASSSPSPSTAVAAPVYAPTPRDRALRTPHSGYHYDGTARPFFEGWYFKVSIPECRQSFCFMYSVENPLFRDGMSDLDRVIHGSRFTGVGAQILGADDKYICQFTEKSNNFWGSRHELMLGNTFIPNNGSTPPEGEVPPQEFSSRVLEGFQVTPIWHQGFIRDDGRSKYVPNVQTARWEYSTRPVYGWGDVTSKQKSTAGWLAAFPFFEPHWQICMAGGLSTGWIEWDGERFEFENAPSYSEKNWGAGFPRKWYWVQCNVFSGASGEVALTAAGGLRKIGLGETYESPSLIGIHYEGKFYEFVPWTGTVSWDIAPWGHWKLSGENKNHLVEIEATTKEPGTALRAPTMEAGLVPACKDTCYGDLRLQMWEKRNDGGKGKMILDATSNMAALEVGGGPWFNGWKGTTVSNEIVNNVVGTQVDVESLFPIPFLKPPGL

SEQ ID NO: 1144 - protein, 205 aa, Oryza sativa
MVQPKKKFRGVRQRHWGSWVSEIRHPLLKRRVWLGTFETAEEAARAYDEAAVLMSGRNAKTNFPVQRNSTGDLATAADQDARSNGGSRNSSAGNLSQILSAKLRKCCKAPSPSLTCLRLDPEKSHIGVWQKRAGARADSNWVMTVELNKEVEPTEPAAQPTSTATASQVTMDDEEKIALQMIEELLSRSSPASPSHGEGEGSFVI

SEQ ID NO: 1145 - protein, 379 aa, Oryza sativa
MSSGGGGGGGGDRHGPYHQHGHLGRGEGADYVYSSSDMESFFFSQPGGVGIGGGGGGVVGAGGADEIMPYSSITDYLQGLLDPSGLARHLDVACPSSQDTVVKQELSVDVTSHDSQGTGGVAGEGVAQATPNSSASFSSSDGEAEGGKSSRRCKKGQAKAEEEDDKDEEDGENSKKPNKPKKKAEKRQRQPRVAFLTKSEVDHLEDGYRWRKYGQKAVKNSPYPRSYYRCTTPKCGVKKRVERSYQDPSTVITTYEGQHTHHSPASLRGGGGGVGIVGGHHHHHLFMPGVHGLPPSHLMPAGFHPELMGLMHHHPAMAAAAANPSMYFPGVAASAPPPPAVAGGGAMPPNDHPPLQQHHFTDYALLQDLFPSTMPSSNP

SEQ ID NO: 1146 - protein, 674 aa, Oryza sativa
MDGTNNHGALMDDWMLPSPSPRTLMSSFLNEEFSSGPFSDIFCDNGSNKHQDGLGKSKAFIDSSREETAQLAKKFESNLFGANQKSSSNGCLSERMAARTGFGVLKIDTSRVGYSTPIRSPVTIPPGVSPRELLESPVFLPNAIAQPSPTTGKLPFLMHSNVKPSIPKKTEDETRHDRVFFFQPILGSKPPTCPVAEKGFSVNHQNQPSVTDNHQELSLQSSSTAAKDFTSATIVKPKTSDSMLDNDDHPSPANDQEENATNKNEEYSSDLIITPAEDGYNWRKYGQKQVKNSEHPRSYYKCTFTNCAVKKVERSQDGQITEIVYKGSHNHPLPPSNRRPNVPFSHFNDLRDDHSEKFGSKSGQATATSWENAANGHLQDVGSEVLTKLSASLTTTEHAEKSVMDKQEAVDISSTLSNEEDDRVTHRAPLSLGFDANDDYVEHKRRKMDVYAATSTSTNAIDIGAVASRAIREPRVVVQTTSEVDILDDGYRWRKYGQKVVKGNPNPRSYYKCTHPGCSVRKHVERSSHDLKSVITTYEGKHNHEVPAARNSGHPSSGSAAAPQATNGLLHRRPEPAQGGGGGSLAQFGYGSAGHRPAEQFGAAAAGFSFGMLPRSIATPAPSPAIAVPAMQGYPGLVLPRGEMKVNLLPQSGNAGAAASQQLMGRLPKQHPQM

SEQ ID NO: 1147 - protein, 333 aa, Oryza sativa
MASPDGGVGDGGAEPHEVMDDLLEMREQAAMLHSMLHGTSPSSCAAAASTRQLNQLIDGVMSRLQSSSLSVMSPGGGGGRRGSGGRKKKGAKAVAGPHRRSSSGRRRSKSPFVRMVTTKELEDGRQWRKYGQKHIQDSPNNPRSYYRCTHRPDQGCMATKQVQTSESNSSEFVISYYGEHTCSDPSTIPFVVEAEAPAADYANLISFGSSGGASTSRVDPLRQSRHRLMAEAVDPTPSCSFANCHSPVLSSECASEAAALSSSLPLSAVVGSAVTTPSTSIVGSAPADYDWPSGLAGGDMAGSFPSSPSSLGFMTGSFGNLPGDDDDMFGFDP

SEQ ID NO: 1148 - protein, 361 aa, Oryza sativa
MESMEGNGGGRLVVTELSHIKELVRQLEGHLGGSGSPDLCKHLASQIFSVTERSIGMIRSGHFDGHRKRSAAAVAAGDLDSATPSPLSDVSDLPFKATKKRKTSTEKKRHQIRVSSTGGVENPPVDDGHSWRKYGQKEILGAKHPRGYYRCTHRHSQGCMATKQVQRTDEDATVFDVIYHGEHTCVHKAVAAGAGKPETETDTNAAAESRLHDLSSGLTVKIEGLTAPPQQQQGGGGWNAMPPFCLSSPVSGLAPPDQHNPFSAPSTPENRLAAAASSAASPATSDSMAAAPFHQAAAGGGDEAWRDAELQEVVSALVAATTTTATAQPAPATAMVDADLSALDAFEFDPGFTIDITSFFA

SEQ ID NO: 1149 - protein, 304 aa, Oryza sativa
MLLRSIGQASHLTDDPPDEKTDATKIKAWKTADDRVMGFIFMSVEVPIRMSFRDHTTAKEMWDYLKQRYTQESGALRFSLLQNLHNLQQQDQSIEEFYNAFTRLSGQLEAQTPKGASGCAQCKAREKHDQENLVYQFVMRLSSQFESIRVQLLGRPTRPTMAEALADLIAEETRLCSLDTTPTPVVTHNVMAAPQRVGAPMGGIPEFSSIAKSDRICSHCKKVGHISDDCFYLHPEKLADYQARRAAVPRPRATASAPVFLDITAAGPSSTSAGGSASSAVSCAPQSLVARPSYQASDWSWPSP

SEQ ID NO: 1150 - protein, 782 aa, Oryza sativa
MNPSARISQVAMAAILPDLATQVLVPAAAVVGIAFAVVQWVLVSKVKMTAERRGGEGSPGAAAGKDGGAASEYLIEEEEGLNEHNVVEKCSEIQHAISEGATSFLFTEYKYVGLFMGIFAVLIFLFLGSVEGFSTKSQPCHYSKDRMCKPALANAIFSTVAFVLGAVTSLVSGFLGMKIATYANARTTLEARKGVGKAFITAFRSGAVMGFLLAASGLVVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMLYPLLISSVGIIACLITTLFATDFFEIKAVDEIEPALKKQLIISTVVMTVGIALVSWLGLPYSFTIFNFGAQKTVYNWQLFLCVAVGLWAGLIIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNSIPGLMEGTTKPDYATCVKISTDASIKEMIPPGALVMLSPLIVGIFFGVETLSGLLAGALVSGVQIAISASNTGGAWDNAKKYIEAGASEHARTLGPKGSDCHKAAVIGDTIGDPLKDTSGPSLNILIKLMAVESLVFAPFFATHGGILFKWF

SEQ ID NO: 1151 - protein, 172 aa, Oryza sativa
MEHQGQHGHVTSRVDEYGNPVGTGAGHGQMGTAGMGTHGTTGGMGTHGTTGGMGTHGTTGTGGGQFQPMREEHKTGGVLQRSGSSSSSSSEDDGMGGRRKKGIKEKIKEKLPGGNKGEQQHAMGGTGGAYGQQGHGTGMTTGTTGAHGTTTTDTGEKKGIMDKIKEKLPGQH

SEQ ID NO: 1152 - protein, 93 aa, Oryza sativa
MQAGGGGDAGDTRGRHRIQAELKKLEQEARFLEEELEELDKTDKVSAALQELMVTAESKADPLLPVTTGPACQSWDRWFEGPQDLRRCKCWFL

SEQ ID NO: 1153 - protein, 812 aa, Oryza sativa
MRKWALSSALLLLLLLLTTLPDPAKKLQVNADDSTDELVDPPKVEEKIGGVPHGLSTDSEVVQREAESISRKTLRSSAEKFEFQAEVSRLMDIIINSLYSNKDIFLRELISNASDALDKIRFLALTDKEVLGEGDTAKLEIQIKLDKEKKILSIRDRGIGMTKEDLIKNLGTIAKSGTSAFVEKMQTGGDLNLIGQFGVGFYSVYLVADYVEVISKHNDDKQHVWESKADGSFAISEDTWNEPLGRGTEIRLHLRDEAKEYVEEDKLKDLVKKYSEFINFPIYLWATKEVDVEVPADEDESSESSEEEESSPESTEEEETEESEEKKPKTKTVKETTTEWELLNDVKAIWLRSPKEVTEEEYTKFYHSLAKDFGDDKPLSWSHFTAEGDVEFKALLFVPPKAPHDLYESYYNSNKSNLKLYVRRVFISDEFDELLPKYLSFLKGLVDSDTLPLNVSREMLQQHSSLKTIKKKLIRKALDMIRKLAEEDPDEYSNKDKTDEEKSAMEEKKGQYAKFWNEFGKSVKLGIIEDATNRNRLAKLLRFESTKSEGKLASLDEYISRMKPGQKDIFYITGSSKEQLEKSPFLERLTKKNYEVIYFTDPVDEYLMQYLMDYEDKKFQNVSKEGLKLGKDSKLKDLKESFKELTDWWKKALDTESVDSVKISNRLSDTPCVVVTSKYGWSANMEKIMQSQTLSDASKQAYMRGKRVLEINPRHPIIKELRDKVAQDSESESLKQTAKLVYQTALMESGFNLPDPKDFASSIYRSVQKSLDLSPDAAVEEEEEVEEAEVEEKESSNIKEEAEPSSYDKDEL

SEQ ID NO: 1154 - protein, 288 aa, Oryza sativa
MELGGNNMGPDNGANNNSNLAARQRLRWTNELHERFVEAVTQLGGPDRATPKGVLRIMGVQGLTIYHVKSHLQKYRLAKYIPDSSADGNKAENKDPGDLLAGLEGSSGLQISEALKLQMEVQKRLHEQLEVQRQLQLRIEAQGKYLKKIIEEQQRLGGVKSETPAAGASVTLPSDQFPDSERTDPSTPAPTSESPTQGVPSNRDNGGQNEATKSPQRDDSLSRHEPLTPDSNCQPGSPTASPKHERAAKRQRGNGAEFSETDFALPHSIFESSSGSEFQQCSMSYSGH

SEQ ID NO: 1155 - protein, 466 aa, Oryza sativa
MAAAFSSTVGAPASTPTNFLGKKLKKQVTSAVNYHGKSSNINRFKVMAKELDEGKQTDQDRWKGLAYDISDDQQDITRGKGFVDSLFQAPTGDGTHEAVLSSYEYLSQGLRTYDFDNTMGGFYIAPAFMDKLVVHISKNFMTLPNIKVPLILGIWGGKGQGKSFQCELVFAKMGINPIMMSAGELESGNAGEPAKLIRQRYREAADIIKKGKMCCLFINDLDAGAGRMGGTTQYTVNNQMVNATLMNIADNPTNVQLPGMYNKEDNPRVPIIVTGNDFSTLYAPLIRDGRMEKFYWAPTRDDRVGVCKGIFRTDNVPDEDIVKIVDSFPGQSIDFFGALRARVYDDEVRKWVSDTGVENIGKRLVNSREGPPEFEQPKMTIEKLMEYGYMLVKEQENVKRVQLAEQYLSEAALGDANSDAMKTGSFYGQGAQQAGNLPVPEGCTDPVAKNFDPTARSDDGSCLYTF

SEQ ID NO: 1156 - protein, 360 aa, Oryza sativa
MEKYEAVRDIGSGNFGVARLMRNRETRELVAVKCIERGHRIDENVYREIINHRSLRHPNIIRFKEVILTPTHLMIVMEFAAGGELFDRICDRGRFSEDEARYFFQQLICGVSYCHHMQICHRDLKLENVLLDGSPAPRLKICDFGYSKSSVLHSRPKSAVGTPAYIAPEVLSRREYDGKLADVWSCGVTLYVMLVGAYPFEDQDDPKNIRKTIQRIMSVQYKIPDYVHISAECKQLIARIFVNNPLRRITMKEIKSHPWFLKNLPRELTETAQAMYYRRDNSVPSFSDQTSEEIMKIVQEARTMPKSSRTGYWSDAGSDEEEKEEEERPEENEEEEEDEYDKRVKEVHASGELRMSSLRI

SEQ ID NO: 1157 - protein, 365 aa, Oryza sativa
MEKYELLKDIGSGNFGVARLMRNRETKELVAMKYIPRGLKIDENVAREIINHRSLRHPNIIRFKEVVLTPTHLAIVMEYAAGGELFDRICSAGRFSEDESRYFFQQLICGVSYCHFMQICHRDLKLENTLLDGSPAPRLKICDFGYSKSSLLHSKPKSTVGTPAYIAPEVLSRREYDGKMADVWSCGVTLYVMLVGAYPFEDPDDPKNFRKTIGRIVSIQYKIPEYVHISQDCRQLLSRIFVANPAKRITIREIRNHPWFMKNLPRELTEAAQAKYYKKDNSARTFSDQTVDEIMKIVQEAKTPPPSSTPVAGFGWTEEEEQEDGKNPDDDEGDRDEEEGEEGDSEDEYTKQVKQAHASCDLQKS

SEQ ID NO: 1158 - protein, 361 aa, Oryza sativa
MERAAAGPLGMEMPIMHDGDRYELVKEIGSGNFGVARLMRNRASGDLVAVKYIDRGEKIDENVQREIINHRSLRHPNIIRFKEVILTPTHLAIVMEYASGGELFERICSAGRFSEDEARFFFQQLISGVSYCHSMQVCHRDLKLENTLLDGSTAPRLKICDFGYSKSSVLHSQPKSTVGTPAYIAPEVLLKKEYDGKIADVWSCGVTLYVMLVGAYPFEDPEDPKNFRKTIQKILGVQYSIPDYVHISPECRDLITRIFVGNPASRITMPEIKNHPWFMKNIPADLMDDGMVSNQYEEPDQPMQNMNEIMQILAEATIPAAGTSGINQFLTDSLDLDDDMEDMDSDLDLDIESSGEIVYAM

SEQ ID NO: 1159 - protein, 159 aa, Oryza sativa
MSLIRRGNAFDPFSLDLWDPVDGFPFGSGGSSSSSGSLFPRANSDAAAFAGARIDWKETPEVHVFKADVPGLKKEEVKVEVDDGNILQISGERSREQEEKSDKWHRVERSSGKFLRRFRLPENTKPEQIKASMENGVLTVTVPKEEPKKPDVKSIQISG

SEQ ID NO: 1160 - protein, 554 aa, Oryza sativa; identical to SEQ ID NO: 1055

SEQ ID NO: 1161 - protein, 316 aa, Oryza sativa; identical to SEQ ID NO: 1131

SEQ ID NO: 1162 - protein, 303 aa, Oryza sativa; identical to SEQ ID NO: 1092

SEQ ID NO: 1163 - protein, 488 aa, Oryza sativa
MYTSPTLLALSFALLLLILLLYYSSSLLYSQLATRRRLTHACARSLPDAYESGMNRGHISSSELIDAKLEERRISTAKHCPSCGNKLDCKPKDWVGLPAGVKFDPTDQELIEHLEAKVREEGSRSHPLIDEFIPTIEGEDGICYTHPEKLPGVTRDGLSKHFFHRPSKAYTTGTRKRRKIQTECDVQKGETRWHKTGKTRPVMVSGRQKGCKKILVLYTNFGKHRKPEKTNWVMHQYHLGDLEEEKEGELVVCKIFYQTQPRQCSWSSDRGGGAAATASAVTTAAVQQDQQRRRDSGSGSCSSTRDHEVSATSYSTAGYAVAAAVEMQHLKHAADHFSFAPFRKSFEEVGISGDQVHSNQLGRSEQQHAGQEQQPHRPLLATTTAVPATAFLISRPTNPVSNIVPPAMQHASVVLDHDQFHVPAILLHHDKFQQQQQQKLDRRSAGLEELIMGCTSSSTKGEASIPHSQETEWPYQPYWTPDNQDHHG

SEQ ID NO: 1164 - protein, 403 aa, Oryza sativa
MGVLSRPEEVLPLVKLRVAAGRIKRQIPPEEHWAFAYTMLQRVSRSFALVIQQLGPDLRNAVCIFYLVLRALDTVEDDTSIPAAVKVPILKEFHRHIYNRDWHYSCGTKDYKLLMDKFRLVSTAFLELGQGYQEAIEEITRLMGAGMAKFICKEVETVDDYNEYCHYVAGLVGYGLSRLFHAGGTEDLASDSLSNSMGLFLQKINIIRDYLEDINEIPKSRMFWPREIWSKYVNKLEDLKYEENSEKAVQCLNDMVTNALSHAEDCLQYMSALKDHAIFRFCAIPQIMAIGTCAICYNNVNVFRGVVKMRRGLTARVIDETNTMSDVYTAFYEFSSLIESKIDNNDPNASLTRKRVDAIKRTCKSSCSLKRRGYDLEKSKYNSMLIMVVLLLVAIVLGMIYAK

SEQ ID NO: 1165 - protein, 629 aa, Oryza sativa
MIPACDPHDGPACLELIEVLTTRAAAVQRRVLAEVLAMNTGTDYLRRFLGDEVVAAAGGEDELAAAFKERVPVVEYEDVKPYIERIANGAPSSLISSKPITELLTSSGTSGGQPKLMPATEEELDRKTFLYNLLVPVMNKYVEGLDEGRGMYLLFVKPEITTASGMVARPVLTSYYKSRHFRRRPDSPYTRYTSPDAAILCPDSRQSMYAQLLCGLARRGEVLRVGAVFASAFLRAVKFLEGHWRALCADIRAGRADPAVVTDAACRGAVDAVLAARADPDLADAIAAECGGASWRGIVRRLWPRTKYIDVIVTGSMAQYIPLLEFYGGGLPLVSTMYASSESYFGINLRPLDPPEEVVYTLLPNMCYYEFIKVEKDGDGEKVRDGEVVDLVGVEVGAYYELVVTTFTGLYRYRVGDILQVAGFHNAAPQFRFVHRRNVVLSVDTDKTSEDDLLRAVTAAKPLLDPLSCVLAEYTAYADTSSIPGHYVLFWELTPSPSPPPPPCHDDADDAADIGEDKDKVAHVMAACCAAVEAGLDSVYRRCRSRDRSIGPLEIRVVAPGAFDALMDMCVSHGSSVNQYKTPRCIKHPDAIAVLEQRVVGRFFSDAVPHWEPLKVDGAAAAPATGSDQ

SEQ ID NO: 1166 - protein, 318 aa, Oryza sativa
MDDDGDGSSSPTDDSAAAGLLPLFSRSPAEDLEEKLRRAMEENARLTRALDAILAGHHAHQRALLAPSLSPPPPSATARAPSVSTSCAAREDAAPAVAAAAASTACPSRQQPPTAEPRPKVRTVRVRADAADATDANSMAETVKDGYQWRKYGQKVTRDNPYPRAYFRCAFAPSCPVKKKLQRCAEDRSMLVATYEGEHNHALSTQTTEFVASGCTTSQHAGGSSSSPLPCSISINSSGRTITLDLTNQAGSGSIASCGVEAAAVSGELVTVLSPELRRHLVEEVVQVLKNDAEFVEAVTNAVAARVVDQIPHIPVHL

SEQ ID NO: 1167 - protein, 227 aa, Oryza sativa
MALEALTSPRLASPIPPLFEDSSVFHGVEHWTKGKRSKRSRSDFHHQNLTEEEYLAFCLMLLARDNRQPPPPPAVEKLSYKCSVCDKTFSSYQALGGHKASHRKNLSQTLSGGGDDHSTSSATTTSAVTTGSGKSHVCTICNKSFPSGQALGGHKRCHYEGNNNINTSSVSNSEGAGSTSHVSSSHRGFDLNIPPIPEFSMVNGDDEVMSPMPAKKPRFDFPVKLQL

SEQ ID NO: 1168 - protein, 180 aa, Oryza sativa
MICSYSRTIVARSFSLPVAMAQESWKNESEETVHTPEAPILCVNNCGFFGSSMTNNMCSKCYRDFVKVTTMAAPVVEKKAFTPASSSKTPLEPAKPDEVPAAAVEDKQAAQEPPKPPSNRCLSCRKKVGLTGFQCRCGGTFCSTHRYTEAHDCTFDYKKAGRDQIAKQNPVVIAEKINKI

SEQ ID NO: 1169 - protein, 171 aa, Oryza sativa
MTITREEAESKEMESLRVHASALLSLSSPAASASQPTSSSSTTEGVFECKTCSKRFPSFQALGGHRTSHTRLQAKLLSDPAAAAAAAAERDRARVHECAVCGVEFSMGQALGGHMRRHRGETGTTTVVLADADDSGGATVPQPPEPMPDLNYPPLEDAGDGSEPELLNLLV

SEQ ID NO: 1170 - protein, 173 aa, Oryza sativa
MEHKEAGCQQPEGPILCINNCGFFGSAATMNMCSKCHKEMIMKEEQAKLAASSIDSIVNGCDGGKEHIVAASGSTAVAVAQVEAKTLVVQPTDVAGTSEEVAVVPKVKEGPNRCATCRKRVGLTGFNCRCGNMYCALHRYSDKHECQFDYRTAARDAIAKANPVVKAEKLDKI

SEQ ID NO: 1171 - protein, 247 aa, Oryza sativa
MAVEAVLEASRSSSEEEAEVIVTHGGGGGGGGGGGQVEGWGKRKRSRRRRPQLPPSEEEYLALCLLMLARGRRDGDDVAASASAAAAAVEHRCSVCGKAFASYQALGGHKASHRKPPPPAMVDDDEVVVETKPAAIATPSSSASGVSGGGGGRAHECNVCGKAFPTGQALGGHKRCHYDGTIGSAAGAGASKPAAKTTVAVAASRGFDLNLPALPDVAAAADQRCAAEDDEVLSPLAFKKPRLMIPA

SEQ ID NO: 1172 - protein, 220 aa, Oryza sativa
MTAALQALLDPTALSLGLPTPAINKEEYLAICLAALACTRAGKALVGVGGQQQVQACNKWLCPAPAAPEELRFRCTVCGKAFASYQALGGHKSSHRKPPSPGDHYGAAAAAQQLASAGDSKEDSASSAAGSTGPHRCTICRRSFATGQALGGHKRCHYWDGTSVSVSVSASASAASSAVRNFDLNLMPLPESTAAAGIKRWAEEEEVQSPLPVKKLRMSN

SEQ ID NO: 1173-1174 - skipped (2 entries)

SEQ ID NO: 1175 - protein, 178 aa, Oryza sativa
MYLLSPRNGDEEDEQEEIQELISDDEPPNLKLASCATAASSSSSSGSDMEKGRGKACGGGSTAPPPPPPSSSGKSGGGGGSNIREAAASGGGGGVWGKYFSVESLLLLVCVTASLVILPLVLPPLPPPPSMLMLVPVAMLVLLLALAFMPTTTSSSSSAGGGGGGGRNGATTGHAPYL

SEQ ID NO: 1176 - protein, 173 aa, Oryza sativa
MSVAPATEGSARRSAAAAAAEEEERQRNRKRSNRLSAQRSRIKKQQYVDGLAVEAEQLRRENDAMRAGAGAVLQRCRLVEQENRVLAAHARELCSALQLRASQLRLLGEVAGVPLDVPDVADHLVQLYGGDLGMTPLSPPPLLPPLPPQIEMLYFQPDSVMDPVSMLQGYENI

SEQ ID NO: 1177-1180 - skipped (4 entries)

SEQ ID NO: 1181 - protein, 100 aa, Oryza sativa
MHLTLEFGGGLELLLEKSTKVHKVDLQPNDGDGKVVMKGLLAWVKSNLIKERPEMFLKGDSVRPGVLVLINDCDWELCGGLDAELEEKDVVVFISTLHGG

SEQ ID NO: 1182 - protein, 416 aa, Oryza sativa
MKLLGWMHRKLRSNNDVFKEFNTGGGGACNCITGLASPDHDNDYFSGDDAAHASPPVTAGDLFTFGGSGLLTIGTLGIAAVAIPSGGDDDDYDIDFEVDATSDDDGGFTVEDDDADVGGAVTPTFTFPAATAAEAVVATVEKAVAAVEAIAEKDDDTTTEDDLMVVSAELEKVLGGVDVASARVSFAMGGGVDCPLQGFLFGSPVSDVESRPEYLQAPRDSSGSCGGGGRRTSLGELFMRTRFADEKVALVAVAEGEDGVAGDDGAAAAGVGGDRAGKGGGYKTMKKRKVKDEKGGGGAAGGGMPATVTKSKFQKILQIFHRKVYPENTLLTRNLTKKSRNRGATDNGGGAVATGDPDGPLASPVLRCRKDHPMRGFGCCTNGAFGASSPGGNAEMNGNKSGHWIKTDADYLVLEL

SEQ ID NO: 1183 - protein, 215 aa, Oryza sativa
MHDPRGFPIHPQPYHLHPTAGGLGEGRMRGGGRRRPGAKLSTDPQSVAARERRHRISDRFRVLRSLVPGGSKMDTVSMLEQAIHYVKFLKAQVTLHQAALVQHEEGCQHADVAAAFSAADADLALELNHRHGGAGDDDAGMTTLEMAPMQEAVGYGDGPAHQMMQQALDPAGQLMMGGAHQLPPLPCCVFVQETDPSCYSVCNVHGEESGAQGSY

SEQ ID NO: 1184 - protein, 527 aa, Oryza sativa
MEVAMVCTRVNLLILILSLCSPYKFIQSPMDFGPLNLLPTTTTASSDFGRILFHSPSAVLKPQAPRDISLLLSFLSASPLGKVTVAARGAGHSIHGQAQALDGIVVEMSSLPSEIEFYRRGEGDVSYADVGGGIMWIELLEQSLKLGLAPRSWTDYLYLTIGGTLSNAGISGQTFKHGPQISNVLQLEVVTGRGEIVTCSPTKDAELFNAVLGGLGQFGIITRARILLQEAPQKVKWVRAFYDDFATFTKDQELLVSMPVLVDYVEGFIVLNEQSLHSSSIAFPTNVDFNPDFGTKNNPKIYYCIEFAVHDYQNKNINVEQVVEVISRQMSHIASHLYSVEVSYFDFLNRVRMEEMSLRNSGLWEVHHPWLNMFVPSAGISDFRDLLMDSISPDNFEGLILIYPLLRHKWDTNTSVVLPDSGSTDQVMYAVGILRSANPDDGCSHHCLQELLLRHRRLAGAAASGLGAKQYLAHHPTPAGWRRHFGRRWERFADRKARFDPRCILGPGQGIFPRDSSSSNGAFASYS

SEQ ID NO: 1185 - protein, 565 aa, Oryza sativa; identical to SEQ ID NO: 1008

SEQ ID NO: 1186 - protein, 157 aa, Oryza sativa
MACVNMYNPEHHHHQSSSFMAPRISFSSDFALEPPPPAQQQPAVRAPGDADFEFSVGSHPMMAADQLISKGRLLPLREAPHGHGGADAGGRPLTLRDELRTDSRHGRVPRAPNIRWKEFLGLKKAPKKAPTADAAAGATSSSADTQMDLGGQGSTRD

SEQ ID NO: 1187 - protein, 176 aa, Oryza sativa
MMDLGFLEGGAGMADAGHDESGSPPRSGGVREQDRFLPIANISRIMKKAVPANGKIAKDAKETLQECVSEFISFVTSEASDKCQKEKRKTINGEDLLFAMGTLGFEEYVDPLKIYLHKYREMEGDSKLSSKAGDGSVKKDTIGPHSGASSSSAQGMVGAYTQGMGYMQPQYHNGDT

SEQ ID NO: 1188 - protein, 221 aa, Oryza sativa; identical to SEQ ID NO: 1113

SEQ ID NO: 1189 - protein, 221 aa, Oryza sativa; identical to SEQ ID NO: 1114

SEQ ID NO: 1190 - protein, 167 aa, Oryza sativa
MDPSSASWPAPASPPVELSLSLPAAAARNRDEAAPTAIVDGKQVRLFPCLFCAKTFRKSQALGGHQNAHRKERVAGGSWNPNVYGDGGGSASMPIASHGVTAAGSSTAADGRWCGGAASDDDTTAAPMPSLGSGSAALGAGAGFASTERGSSGGGVAGEELVLELGL

SEQ ID NO: 1191 - protein, 416 aa, Oryza sativa
MMNVPSAAAASSCDDFGYNATPPPPPSLLPIMDQDGGGGSIQRDHHQHHNHQQLGYNLEPSSLALLPPSNAAAAAAHHATIAHASPHDLLQFYPTSHYLAAAGGAGGGGNPYSHFTAAAAAGSTFQSYYQQPPQDAPEYYFPTLVSSAEENMASFAATQLGLNLGYRTYFPPRGGYTYGHHPPRCQAEGCKADLSSAKRYHRRHKVCEHHSKAPVVVTAGGLHQRFCQQCSRFHLLDEFDDAKKSCRKRLADHNRRRRKSKPSDGEHSGEKRRAQANKSAATKDKAGSSSKNAGIGDGFETQLLGGAHMSKDQDQAMDLGEVVKEAVDPKGKASMQQQQQQAHHGIHQQSHQQHGFPFPSSSGSCLFPQSQGAVSSTDTSNIAQVQEPSLAFHQQHHQHSNILQLGQAMFDLDFDH

SEQ ID NO: 1192 - protein, 282 aa, Oryza sativa; identical to SEQ ID NO: 1123

SEQ ID NO: 1193 - protein, 438 aa, Oryza sativa
MKICSRYELPNLVPNSELLLALLTPLTNRPKSERRRRRNPPPPPTEARAGQAVVGRGGEERRMAKLGPGQGLGCEAAVGLLAPSRKREYKACNKLTEGKRPLYAIGFNFLDFHYYEVFATVGGNRVTTYSCLKDGNFAILQAYIDEDKDESFYTLSWACDLDGTPLLVAAGSNGIIRVINCATEKLLKTFVGHGDSINEIRTQALKPSLIISASKDESVRLWNVHTGICILIFAGAGGHRNEVLSVDFHPSDIYRIASCGMDNTVKIWSMKEFWPYVEQSFTWTDLPSKFPTKYVQFPVLVAVVHSNYVDCTRWLGDFILSKSVDNEIVLWEPKTKEQSPGEGSIDILQKYPVPECDIWFIKFSCDFHFNQLAIGNREGKVFVWEVQSSPPVLTARLTNPQCKSAIRQTAVSFDGSTILACSEDGSIWRWDEVDHPKA

SEQ ID NO: 1194 - protein, 675 aa, Oryza sativa
MVAGAPVGFVYTSRRREARRQRRVVAIAIAFLLLLLRRRALPRHRAPRAIGGGRPRPRARERGARDYRTSRFAELSRMVDWASDSDNDKFEWDTDGEAETSSAPALRNIDAPGPSTRLPQDANGKANGSGALVAEFMGMGFPKEMILKAIKEIGDTDTEQLLELLLTYQAIGGDASVGNCSASACAPQTLEVDEEEDDTNWDEYDTAGNCDRTPHSDGSGDEDFFQEMSEKDEKMKSLVNMGFPEDEAKMAIDRCGLDAPVAVLVDSIYASQEAGNGYSANLSDYEDTEFSSFGGRKKTRFVDGSKKRKRYGSGPSGNQVPFDGSHEEPMPLPNPMVGFSLPNERLRSVHRNLPDQALGPPFFYYENVALAPKGVWTTISRFLYDIQPEFVDSKYFCAAARKRGYIHNLPIENRSPVLPMPPKTISEAFPNTKRWWPSWDPRRQFNCLQTCMASAKLTERIRCALGRFSDVPTPQVQKYVLDECRKWNLVWVGKNKVAPLEPDEMEFLLGYPRNHTRGVSRTERYRALGNSFQVDTVAYHLSVLRDLFPNGMNVLSLFSGIGGAEVALHRLGIHMKTVISVEKSEVNRTILKSWWDQTQTGTLIEIADVRHLTTERIETFIRRFGGFDLVIGGSPCNNLAGSNRHHRDGLEGEHSALFYDYIRILEHVKATMSAV

SEQ ID NO: 1195 - protein, 258 aa, Oryza sativa
MARCTLLVLLVAAAVAVVPLAAGQPWATCGDGTYEQGSAYENNLLNLALTLRDGASSQEILFSTGSNGAAPNTVYGLLLCRGDISRAACYDCGTSVWRDAGSACRRAKDVALVYNECYARLSDKDDFLADKVGPGQLTTLMSSTNISSGADVAAYDRAVTRLLAATAEYAAGDIARKLFATGQRVGADPGFPNLYATAQCAFDITLEACRGCLEGLVARWWDTFPANVDGARIAGPRCLLRSEVYPFYTGAPMVVLRE

SEQ ID NO: 1196 - protein, 574 aa, Oryza sativa; identical to SEQ ID NO: 1014

SEQ ID NO: 1197 - protein, 581 aa, Oryza sativa
MTICSCEETINEFEMLTRDAARVQKDTLKKILEINASAEYLQNFGLGGRTDAESYKSCIPLCVHNDIEPYIQRIVDGDTSPVVTGEPITNLSLSSGTTHGKPKFIPFNDELLETTLQIYRTSYAFRNREYPIGQGKALQFVYGSKQVITKGGILATTATTNLYRRQRYKEGMKDIQSQCCSPDEVIFGPDFHQSLYCHLLCGLIYSEEVHSVFSTFAHSLVHAFQTFEEVWEDLCTDIRDGVLSKKVTAPSIREAVSKILKPNPELADSIYKKCIGLSNWYGVIPALWPNAKYVYGIMTGSMEPYLKKLRHYAGNLPLISADYGASEGWVGSNIDPTVPPEQVTYAVLPQVGYFEFIPLEKPIGEETENSASIHYIESDPVGLTEVEVGKIYEVVITNFAGLYRYRLGDVVKIARFHNSTPELQFICRRSLVLSINIDKNTEKDLQLAVEEASKFLEGEKLEVMDFTSFVERSSDPGRYVIFWELSGDASDEVLSSCANALDLAFIDAGYTGSRKIKTIGPLELRILRKGTFKEILDHFLSLGGAVSQFKTPRFVNPSNSKVLQILSRNVTQSYFSTAYGF

SEQ ID NO: 1198 - protein, 628 aa, Oryza sativa
MLEKKATRSTRVDGVSGEAVIEEFERVTRDAANVQRETLRRILAENGGVEYLRGLGLAGATDPATFRARVPLATHADLEPYIDRIADGDASPVLTAKPATSISLSSGTTQGKRKYLLFNEELVKSTMQIYRISYAFRNREFPVENGKALQFIYSSRETRTKGGLTATTATTNVYRSEEFKATMRDIQSQCCSPDEVIFGPDFAQSLYCHLLAGLLAAGDVQIVSATFAHSVVLAFQTFERAWEDLCADIRRGEVSPSRVTSPAVRRAMAALLAAPNPGLADEVARKCAALSNWYGVIPALWPNARYVYGIMTGSMEHYVKKLRHYAGGLPLVAAEYGASEGWVGANVEPGTPPERATFTVLPDIAYFEFIPLKPVAGDGGYAEAEPVGLTEVAAGELYEVVMTTFAEETTTKNSSVVMSGNRIRIGDRLPGTAQVGSRALPVSAGGRGEGGRVLQRDAQAQVRVQEEPDAVDQHRQEQRAGPAAGGGRGGEGGARRREAGGGGLHQPRRRVVGPGPLRRLPGAQRRRPRRRRRRRDAGLLRRAGQGVRRRRLRRVEEVRRHRPARAPRAAAWNLPEGSPPLPLPRRPRQPVQVPPLRLPLQLRRPPDPRRLHRQRLLQLRLRLIIQSN

SEQ ID NO: 1199 - protein, 338 aa, Oryza sativa; identical to SEQ ID NO: 932

SEQ ID NO: 1200 - protein, 318 aa, Oryza sativa
MNTRGSGSSSSSSSSQASLMAFSEPPKPASQPSPPSSPMSERPPSGRSRRRAQEPGRFLGVRRRPWGRYAAEIRDPTTKERHWLGTFDTAQEAALAYDRAALSMKGAQARTNFVYTHAAYNYPPFLAPFHAPQYAAAAAAPSSVQYGGGVGAAPHIGSYGHHHHHHHHHGHGAASGASSVGECSTMPVMVPVDPHRSSMSSSLLDMDRNGHDFLFSGADDNSGYLSSVVPESCLRPRGGGAAADHQDMRRYSDADAYGMMGLREDVDDLAQMVAGFWGGGDAADQLGACGFPASGGAADMVASSQGSDSYSPFSFLSH

SEQ ID NO: 1201 - protein, 276 aa, Oryza sativa
MSSSSAAALGSDDGCSPAELRPSRYESQKRRDWQTFTQYLAAHRPPLELRRCSGAHVLEFLRYLDRFGKTRVHEPPCPSYGGRSPSAAGPVAAAAAACQCPLRQAWGSLDALVGRLRAAYDERHGRAGEPDAVAGAGAVATDSTSSSSAAAANPFAARAVRLYLRDVRDAQAMARGISYHKKKKRRGGNMNGARGGGGGGARAGVNDGDATAPPVAVTPGLPLPPLPPCLNGVPFEYCDFGSVLGGAHGAHGGHGGGGGGFYGAGVYLPFLYNTFS

SEQ ID NO: 1202 - protein, 204 aa, Oryza sativa
MEFVAHAAAPDSPHSDSGGGGGGMATGATSASAAGASPSRYESQKRRDWNTFGQYLRNHRPPLSLARCSGAHVLEFLRYLDQFGKTKVHAPACPFFGHPAPPAPCPCPLRQAWGSLDALVGRLRAAYEENGGRPENNPFGARAVRLYLREVREHQARARGVSYEKKKRKKPPHPSSAAAAHDDAANGALHHHHHMPPPPPGAAA

SEQ ID NO: 1203 - protein, 994 aa, Oryza sativa
MPPTLLLLLLLLPPSLASPDRDIYALAKLKAALVPSPSATAPPPLADWDPAATSPAHCTFSGVTCDGRSRVVAINLTALPLHSGYLPPEIALLDSLANLTIAACCLPGHVPLELPTLPSLRHLNLSNNNLSGHFPVPDSGGGASPYFPSLELIDAYNNNLSGLLPPFSASHARLRYLHLGGNYFTGAIPDSYGDLAALEYLGLNGNTLSGHVPVSLSRLTRLREMYIGYYNQYDGGVPPEFGDLGALLRLDMSSCNLTGPVPPELGRLQRLDTLFLQWNRLSGEIPPQLGDLSSLASLDLSVNDLAGEIPPSLANLSNLKLLNLFRNHLRGSIPDFVAGFAQLEVLQLWDNNLTGNIPAGLGKNGRLKTLDLATNHLTGPIPADLCAGRRLEMLVLMENGLFGPIPDSLGDCKTLTRVRLAKNFLTGPVPAGLFNLPQANMVELTDNLLTGELPDVIGGDKIGMLLLGNNGIGGRIPPAIGNLPALQTLSLESNNFSGALPPEIGNLKNLSRLNVSGNALTGAIPDELIRCASLAAVDLSRNGFSGEIPESITSLKILCTLNVSRNRLTGELPPEMSNMTSLTTLDVSYNSLSGPVPMQGQFLVFNESSFVGNPGLCGGPVADACPPSMAGGGGGAGSQLRLRWDSKKMLVALVAAFAAVAVAFLGARKGCSAWRSAARRRSGAWKMTAFQKLEFSAEDVVECVKEDNIIGKGGAGIVYHGVTRGAELAIKRLVGRGGGEHDRGFSAEVTTLGRIRHRNIVRLLGFVSNRETNLLLYEYMPNGSLGEMLHGGKGGHLGWEARARVAAEAACGLCYLHHDCAPRIIHRDVKSNNILLDSAFEAHVADFGLAKFLGGATSECMSAIAGSYGYIAPEYAYTLRVDEKSDVYSFGVVLLELITGRRPVGGFGDGVDIVHWVRKVTAELPDNSDTAAVLAVADRRLTPEPVALMVNLYKVAMACVEEASTARPTMREVVHMLSNPNSAQPNSGDLLVTF

SEQ ID NO: 1204 - protein, 122 aa, Oryza sativa
MGRLFLCLVVAWCWVALLLVAPVHGRVGLPGEFSGDQRPVPATSFDLVTEPKTKQPRGVKGTRRPSWSSWSSTASRSSPPPGRGAPSAAAAAELRSVPAGPDPMHHHGSPRRPEHARSTGRP

SEQ ID NO: 1205 - protein, 332 aa, Oryza sativa
MASTASFMLAVLLAVAVAAAPARAVRCPPSDKQALMRVKQSLGNPATLSTWSLASADCCEWDHVRCDEAGRVNNVFIDGANDVRGQIPSAVAGLTALMSLSLFRLPGLSGPIPACLTALSNLQFLTISHTNVSGVIPDSLARIRSLDSVDLSHNSLTGPIPNSFSDLPNLRSLDLRSNKLTGCIPAGLVQGQFRSLILSYNQLTGPIPRDDAQDEINTVDLSHNRLTGDASFLFAAGRPIGKVDLSWNDLDFDLSKLVFPPELTYLDLSHNRIRGTVPRSLAALSTLQTLDLSYNRLCGPLPRLHGVIRHGCKPYEHNQCAGGAPLGGCHQS

SEQ ID NO: 1206 - protein, 201 aa, Oryza sativa
MAFASGRFYCMSSSPFAVLVFDVAENVWSKVQPPMRRFLRSPALVELGGGREGAARVALVSAVEKSRLSVPRSVRLWTLRGGGGGGGGGAWTEVARMPPEVHAQFAAAEGGRGFECAAHGDYVVLAPRGPVAQAPTSALVFDSRRDEWRWAPPCPYVVVAHHGGAGAAGFRVFAYEPRLATPAIGLLDATAPVALHGMHDG

SEQ ID NO: 1207 - protein, 405 aa, Oryza sativa; identical to SEQ ID NO: 946

SEQ ID NO: 1208 - protein, 276 aa, Oryza sativa
MMNMMTDLSCGPSSMTELTAAAAPAGSGSSAAVAAGSSEKMGRGKIEIKRIENTTNRQVTFCKRRNGLLKKAYELSVLCDAEVALIVFSSRGRLYEYANNSVKSTVERYKKANSDTSNSGTVAEVNAQHYQQESSKLRQQISSLQNANSRTIVGDSINTMSLRDLKQVENRLEKGIAKIRARKNELLYAEVEYMQKREVELQNDNMYLRSKVVENERGQQPLNMMGAASTSEYDHMVNNPYDSRNFLQVNIMQQPQHYAHQLQPTTLQLGQQPAFN

SEQ ID NO: 1209 - protein, 250 aa, Oryza sativa
MGRGRVELKRIENKINRQVTFSKRRNGLLKKAYELSVLCDAEVALIIFSSRGKLYEFGSAGITKTLERYQHCCYNAQDSNNALSETQSWYHEMSKLKAKFEALQRTQRHLLGEDLGPLSVKELQQLEKQLECALSQARQRKTQLMMEQVEELRRKERQLGEINRQLKHKLEVEGSTSNYRAMQQASWAQGAVVENGAAYVQPPPHSAAMDSEPTLQIGYPHQFVPAEANTIQRSTAPAGAENNFMLGWVL

SEQ ID NO: 1210 - protein, 389 aa, Oryza sativa
MDPNDAFSAAHPFRWDLGPPAPAPVPPPPPPPPPPPPANVPRELEELVAGYGVRMSTVARISELGFTASTLLAMTERELDDMMAALAGLFRWDLLLGERFGLRAALRAERGRLMSLGGRHHGHQSGSTVDGASQEVLSDEHDMAGSGGMGDDDNGRRMVTGKKQAKKGSAARKGKKARRKKVDDLRLDMQEDEMDCCDEDGGGGSESTESSAGGGGGERQREHPFVVTEPGEVARAKKNGLDYLFHLYEQCRLFLLQVQSMAKLHGHKSPTKVTNQVFRYAKKVGASYINKPKMRHYVHCYALHCLDEEASDALRRAYKARGENVGAWRQACYAPLVDISARHGFDIDAVFAAHPRLAIWYVPTRLRQLCHQARSSHAAAAAALPPPLF

SEQ ID NO: 1211 - protein, 518 aa, Oryza sativa
MEEERMEPPPPPPYIHIETNDFLHRRHKRQKEEDIAVCECQYNLLDPDSACGDRCLNVLTSTECTPGYCLCGVYCKNQRFQKSQYAATRLVKTEGRGWGLLADENIMAGQFVMEYCGEVISWKEAKRRSQAYENQGLTDAYIIYLNADESIDATKKGSLARFINHSCQPNCETRKWNVLGEVRVGIFAKQDIPIGTELSYDYNFEWFGGAMVRCLCGAGSCSGFLGAKSRGFQEATYLWEDDDDRFSVENVPLYDSADDEPTSIPKDILIKDEPNTQDGNNNTIQNTGIPIIASSSEFTPMNVEPSIASSNEFTPMNVEPLNVSSNELTPMTIEPLNAIPMGVDFTQNGSIEYGAQCAEDALQNSTRGVANLQNQSAPRDNNHTELVAVKRRPTLRGGKAKRGMRKQLNVVGICDRLASEVAREEILYCEEMKNEAAAEIDSLYDEIRPAIEEHERDSQDSVATSLAEKWIEASCCKYKADFDLYASIIKNLASTPLRSKEDAAPTEQNGLMYLENGP

SEQ ID NO: 1212 - protein, 389 aa, Oryza sativa; identical to SEQ ID NO: 1210

SEQ ID NO: 1213 - protein, 179 aa, Oryza sativa
MAGSGRDRDPLVVGRVVGDVLDAFVRSTNLKVTYGSKTVSNGCELKPSMVTHQPRVEVGGNDMRTFYTLVMVDPDAPSPSDPNLREYLHWLVTDIPGTTAASFGQEVMCYESPRPTMGIHRLVFVLFQQLGRQTVYAPGWRQNFNTKDFAELYNLGSPVAAVYFNCQREAGSGGRRVYP

SEQ ID NO: 1214 - protein, 249 aa, Oryza sativa
MGRGPVQLRRIENKINRQVTFSKRRNGLLKKAHEISVLCDADVALIVFSTKGKLYEFSSHSSMEGILERYQRYSFDERAVLEPNTEDQENWGDEYGILKSKLDALQKSQRQLLGEQLDTLTIKELQQLEHQLEYSLKHIRSKKNQLLFESISELQKKEKSLKNQNNVLQKLMETEKEKNNAIINTNREEQNGATPSTSSPTPVTAPDPIPTTNNSQSQPRGSGESEAQPSPAQAGNSKLPPWMLRTSHT

SEQ ID NO: 1215 - protein, 248 aa, Oryza sativa
MGRGRVELKRIENKINRQVTFAKRRNGLLKKAYELSVLCDAEVALIIFSNRGKLYEFCSGQSMTRTLERYQKFSYGGPDTAIQNKENELVQSSRNEYLKLKARVENLQRTQRNLLGEDLGTLGIKELEQLEKQLDSSLRHIRSTRTQHMLDQLTDLQRREQMLCEANKCLRRKLEESNQLHGQVWEHGATLLGYERQSPHAVQQVPPHGGNGFFHSLEAAAEPTLQIGFTPEQMNNSCVTAFMPTWLP

SEQ ID NO: 1216 - protein, 230 aa, Oryza sativa
MVRGKTQMKRIENPTSRQVTFSKRRNGLLKKAFELSVLCDAEVALIVFSPRGKLYEFASASTQKTIERYRTYTKENIGNKTVQQDIEQVKADADGLAKKLEALETYKRKLLGEKLDECSIEELHSLEVKLERSLISIRGRKTKLLEEQVAKLREKEMKLRKDNEELREKCKNQPPLSAPLTVRAEDENPDRNINTTNDNMDVETELFIGLPGRSRSSGGAAEDSQAMPHS

SEQ ID NO: 1217 - protein, 561 aa, Oryza sativa
MADLQEPLVRPKRKKVLVDYLVKFRWILVIFVVLPISALIYFNIYLGDVWSAMKSEKRRQKEHDDNVQKVVKRLKQRNPKKDGLVCTARKPWIAVGMRNVDYKRARHFEVDLSAFRNILEIDRERMVAKVEPLVNMGQITRATCPMNLALAVVAELDDLTVGGLINGYGIEGSSHLYGLFSDTVVAVEVVLADGRVVRATKDNEYSDLFYGIPWSQGTLGFLVSAEIKLIPIKEYMRLTYTPVKGSLKEIAQGYCDSFAPRDGDPAKVPDFVEGMVYTENEGVMMTGVYASKEEAKKKGNKINCVGWWFKPWFYQHAQTALKKGEFVEYIPTREYYHRHTRCLYWEGKLILPFGDQFWFRFLLGWLMPPKVSLLKATQGESIRNYYHDNHVIQDMLVPLYKVGDALEFVHKEMEVYPLWLCPHRLYKLPVKTMVYPEPGFEHHHRQGDTSYAQMFTDVGVYYAPGAVLRGEEFNGALAVHRLEQWLIENHSYQPQYAVSELNEKDFWRMFDASHYEHCRQKYGAVGTFMSVYYKSKKGRKTEKEVQEAEAAILEPAYADEA

SEQ ID NO: 1218 - protein, 503 aa, Oryza sativa
MATAIPQRQLFVAGEWRAPALGRRLPVVNPATESPIGEIPAGTAEDVDAAVAAAREALKRNRGRDWARAPGAVRAKYLRAIAAKIIERKSELARLETLDCGKPLDEAAWDMDDVAGCFEYFADLAESLDKRQNAPVSLPMENFKCYLRKEPIGVVGLITPWNYPLLMATWKVAPALAAGCTAVLKPSELASVTCLELADVCKEVGLPSGVLNIVTGLGSEAGAPLSSHPGVDKVAFTGSYETGKKIMASAAPMVKPVSLELGGKSPIVVFDDVDVEKAVEWTLFGCFWTNGQICSATSRLILHKKIAKEFQERMVAWAKNIKVSDPLEEGCRLGPVVSEGQYEKIKQFVSTAKSQGATILTGGVRPKHLEKGFYIEPTIITDVDTSMQIWREEVFGPVLCVKEFSTEEEAIELANDTHYGLAGAVLSGDRERCQRLTEEIDAGIIWVNCSQPCFCQAPWGGNKRSGFGRELGEGGIDNYLSVKQVTEYASDEPWGWYKSPSKL

SEQ ID NO: 1219 - protein, 625 aa, Oryza sativa
MKREYQEAGGSSGGGSSADMGSCKDKVMAGAAGEEEDVDELLAALGYKVRSSDMADVAQKLEQLEMAMGMGGVSAPGAADDGFVSHLATDTVHYNPSDLSSWVESMLSELNAPLPPIPPAPPAARHASTSSTVTGGGGSGFFELPAAADSSSSTYALRPISLPVVATADPSAADSARDTKRMRTGGGSTSSSSSSSSSLGGGASRGSVVEAAPPATQGAAAANAPAVPVVVVDTQEAGIRLVHALLACAEAVQQENFAAAEALVKQIPTLAASQGGAMRKVAAYFGEALARRVYRFRPADSTLLDAAFADLLHAHFYESCPYLKFAHFTANQAILEAFAGCHRVHVVDFGIKQGMQWPALLQALALRPGGPPSFRLTGVGPPQPDETDALQQVGWKLAQFAHTIRVDFQYRGLVAATLADLEPFMLQPEGEADANEEPEVIAVNSVFELHRLLAQPGALEKVLGTVHAVRPRIVTVVEQEANHNSGSFLDRFTESLHYYSTMFDSLEGGSSGQAELSPPAAGGGGGTDQVMSEVYLGRQICNVVACEGAERTERHETLGQWRNRLGRAGFEPVHLGSNAYKQASTLLALFAGGDGYRVEEKEGCLTLGWHTRPLIATSAWRVAAA

SEQ ID NO: 1220 - protein, 88 aa, Oryza sativa
MSSRRSSRGSISEEEINELISKLQSLLPNSRRRGSSQASTTKLLKETCNYIKSLHREVDDLSDRLSDLMATMDHNSPGAEIIRSILRS

SEQ ID NO: 1221 - protein, 133 aa, Oryza sativa
MAKWGCQDSRSSESKILFMPHGPDASALISVLVLPDSLSNNTYSVTHACIDYQAPQDMGCGCQMIGEETSQHRDTAESDTHHEVPSSRVLQETCNYIRSLHQEVDDLSERLSELLATSDMSSAQAAIIRSLLM

SEQ ID NO: 1222 - protein, 505 aa, Oryza sativa
MAGGSKTRIHASLVSTLLLLLPLASAIHRSDFPASFLFGTATSSYQIEGAYLEGNKSLSNWDVFTHLPGNIKDGSNGDIADDHYHRYEEDVELMNSLGVNAYRFSISWSRILPKGRFGGVNPAGIDFYNKLIDSILLKGIQPFVTLTHYDIPQELEDRYGAWLNAEIQSDFGHFADVCFGAFGDRVKYWTTFNEPNVAVRHGYMLGTYPPSRCSPPFGHCARGGDSHAEPYVAAHNVILSHATAIEIYKRKYQSKQRGMIGMVLYSTWYEPLRDVPEDRLATERALAFETPWFLDPLVYGDYPPEMRQILGGRLPSFSPEDRRKLRYKLDFIGVNHYTTLYARDCMFSDCPQGQETQHALAAVTGESNGLPIGTPTAMPTFYVVPDGIEKMVKYFMRRYNNLPMFITENGYAQGGDSYTDAEDWIDDEDRIEYLEGYLTKLAKVIRDGADVRGYFAWSVVDNFEWLFGYTLRFGLYYIDYRTQERSPKLSALWYKEFLQNLHENQ

SEQ ID NO: 1223 - protein, 87 aa, Oryza sativa
MSSRRSSRSSVSEEEINELISKLQSLLPSSRRRGANQASTTKLLKETCSYIKSLHREVDDLSDRLSDLMAGMDHNSPGAEIIRSLLR

SEQ ID NO: 1224 - protein, 598 aa, Oryza sativa
MGVLGSRVAWAWLVQLLLLQQLAGASHVVYDDLELQAAATTADGVPPSIVDSELRTGYHFQPPKNWINDPNAPMYYKGWYHLFYQYNPKGAVWGNIVWAHSVSRDLINWVALKPAIEPSIRADKYGCWSGSATMMADGTPVIMYTGVNRPDVNYQVQNVALPRNGSDPLLREWVKPGHNPVIVPEGGINATQFRDPTTAWRGADGHWRLLVGSLAGQSRGVAYVYRSRDFRRWTRAAQPLHSAPTGMWECPDFYPVTADGRREGVDTSSAVVDAAASARVKYVLKNSLDLRRYDYYTVGTYDRKAERYVPDDPAGDEHHIRYDYGNFYASKTFYDPAKRRRILWGWANESDTAADDVAKGWAGIQAIPRKVWLDPSGKQLLQWPIEEVERLRGKWPVILKDRVVKPGEHVEVTGLQTAQADVEVSFEVGSLEAAERLDPAMAYDAQRLCSARGADARGGVGPFGLWVLASAGLEEKTAVFFRVFRPAARGGGAGKPVVLMCTDPTKSSRNPNMYQPTFAGFVDTDITNGKISLRSLIDRSVVESFGAGGKACILSRVYPSLAIGKNARLYVFNNGKAEIKVSQLTAWEMKKPVMMNGA

SEQ ID NO: 1225 - protein, 783 aa, Oryza sativa
MGTNRPRPRTKDFFAAPALSLTLAGVFGRKNGPAASGGDGVEEGDEEVQAAGEAAVEISSENAGPGCRQSQSGGGSGEDGGHDDDDGEGSNKKRRRKNYHRHTAEQIRIMEALFKESPHPDERQRQQVSKQLGLSARQVKFWFQNRRTQIKAVQERHENSLLKSELEKLQDEHRAMRELAKKPSRCLNCGVVATSSDAAAAATAADTREQRLRLEKAKLKAEIERLRGTPGKSAADGIASPPCSASAGAMQTNSRSPPLHDHDGGFLRHDDDKPRILELATRALDELVGMCSSGEPVWVRGVETGRDILNYDEYVRLFRRDHGGSGDQMAGWTVEASRECGLVYLDTMHLVHTFMDVDKWKDLFPTMISKAATLEMISNREDDGRDGVLQLMYAELQTLTPMVPTRELYFARYCKKLAAERWAIVDVSFDESETGVHASSAVRCWKNPSGCLIEEQNNGRCKMTWVEHTRCRRCTVAPLYRAVTASGVAFGARRWVAALQLQCERMVFAVATNVPTRDSTGVSTLAGRRSVLKLAHRMTSSLCRTTGGSCDMAWRRAPKGGSGGGGDDDIWLTSRENAGDDPGEPQGLIACAAASTWLPVNPTALLDLLRDESRRPEWDVMLPGKSVQSRVNLAKGKDRTNCVTAYAARPEEEEERGGKWVLQDVCTNPCESTIAYAAIDAAALQPVIAGHDSSGVHLLPCGFISVMPDGLESKPAVITASRRGGEASGAGSLVTVAFQVPASPSAAAATLSPDSVEAVTVLVSSTLRNIRKALGCDSCEEEF

SEQ ID NO: 1226 - protein, 483 aa, Oryza sativa
MAVAAAAAARRRDVSCLLLLLCFSSSMAATGGGGGGGEQEADRVARLPGQPASPAVSQFAGYVGVDERHGRALFYWFFEAQASPAPEKKPLLLWLNGGPGCSSIGYGAASELGPLRVARQGAALEFNQYGWNKEANLLFLESPVGVGFSYTNTSSDLSNLNDDFVAEDAYSFLVNWFKRFPQYKDNEFYISGESYAGHYVPQLADLVYERNKDKRASTYINLKGFIVGNPLTDDYYDSKGLAEYAWSHAIVSDQVYERIKKTCNFKNSNWTDDCNAAMNIIFSQYNQIDIYNIYAPKCLLNSTSASSPDRAFFANNQEQFRWRIKMFSGYDPCYSSYAEDYFNKHDVQEAFHANASGLLPGKWQVCSDQILNSYNFSVLSILPIYSKLIKAGLRVWLYSSGDADGRVPVISSRYCVEALGLPIKTDWQSWYLDKQVAGRFVEYHGMTMVTVRGAGHLVPLNKPAEGLMLINAFLHGEKLPTSR

SEQ ID NO: 1227 - protein, 232 aa, Oryza sativa
MAMAAAPRPKSPPAPPDPCGRHRLQLAVDALHREIGFLEGEINSIEGIHAASRCCREVDEFIGRTPDPFITISSEKRSHDHSHHFLKKFRCLCRASACCLSYLSWICCCSSAAGGCSSSSSSSFNLKRPSCCCNCNCNCCSSSSSSCGAALTKSPCRCRRRSCCCRRCCCGGVGVRACASCSCSPPCACCAPPCAGCSCRCTCPCPCPGGCSCACPACRCCCGVPRCCPPCL

SEQ ID NO: 1228 - protein, 381 aa, Oryza sativa
MDAAHWHQGLGLVKPMEEMLMGANPNPNGSSNQPPPPPSSAASAQRPIAPPAAGAAAGAGAAGAGAGTERRARPQKEKALNCPRCNSTNTKFCYYNNYSLQQPRYFCKTCRRYWTEGGSLRNVPVGGGSRKNKRSSSSVVPSAAASASTSAAVSGSVPVGLAAKNPKLMHEGAQDLNLAFPHHHGRALQPPEFTAFPSLESSSVCNPGGNLAAANGAGGRGSVGAFSAMELLRSTGCYVPLPQMAPLGMPAEYAAAGFHLGEFRMPPPPQQQQQQQAQTVLGFSLDTHGAGAGGGSGVFGACSAGLQESAAGRLLFPFEDLKPVVSAAAGDANSGGDHQYDHGKNQGGGGGVIGGHEAPGFWNSSMIGNGSSNGGGGGGSW

SEQ ID NO: 1229 - protein, 425 aa, Oryza sativa
MGNRIGGRRKAGVEERYTRPQGLYEHRDIDQKKLRKLILEAKLAPCYMGADDAAAAADLEECPICFLYYPSLNRSKCCSKGICTECFLQMKPTHTAQPTQCPFCKTPSYAVEYRGVKTKEERSIEQFEEQKVIEAQMRMRQQALQDEEDKMKRKQNRCSSSRTITPTKEVEYRDICSTSFSVPSYRCAEQETECCSSEPSCSAQTSMRPFHSRHNRDDNIDMNIEDMMVMEAIWRSIQEQGSIGNPVCGNFMPVTEPSPRERQPFVPAASLEIPHGGGFSCAVAAMAEHQPPSMDFSYMAGSSAFPVFDMFRRPCNIAGGSMCNLESSPESWSGIAPSCSREVVREEGECSADHWSEGAEAGTSYAGSDIVADAGTMPQLPFAENFAMAPSHFRPESIEEQMMFSMALSLADGHGRTHSQGLAWL

SEQ ID NO: 1230 - protein, 470 aa, Oryza sativa
MGKAARWFRNMWGGGRKEQKGEAPASGGKRWSFGKSSRDSAEAAAAAAAAAAEASGGNAAIARAAEAAWLRSVYADTEREQSKHAIAVAAATAAAADAAVAAAQAAVAVVRLTSKGRSAPVLAATVAGDTRSLAAAAVRIQTAFRGFLAKKALRALKALVKLQALVRGYLVRRQAAATLQSMQALVRAQATVRAHRSGAGAAANLPHLHHAPFWPRRSLQERCAGDDTRSEHGVAAYSRRLSASIESSSYGYDRSPKIVEVDTGRPKSRSSSSRRASSPLLLDAAGCASGGEDWCANSMSSPLPCYLPGGAPPPRIAVPTSRHFPDYDWCALEKARPATAQSTPRYAHAPPTPTKSVCGGGGGGGIHSSPLNCPNYMSNTQSFEAKVRSQSAPKQRPETGGAGAGGGRKRVPLSEVVVVESRASLSGVGMQRSCNRVQEAFNFKTAVVGRLDRSSESGENDRHAFLQRRW

SEQ ID NO: 1231 - protein, 455 aa, Oryza sativa
MEWDLKMPPAASWELADELENSGGGGVPAAVSSSSAAVGGGVNAGGGGRQECSVDLKLGGLGEFGGGGAQPRVAVAGEPAKGKGPAAAATGAAAAASSAPAKRPRGAAAAGQQQCPSCAVDGCKEDLSKCRDYHRRHKVCEAHSKTPLVVVSGREMRFCQQCSRFHLLQEFDEAKRSCRKRLDGHNRRRRKPQPDPMNSASYLASQQGARFSPFATPRPEASWTGMIKTEESPYYTHHQIPLGISSRQQHFVGSTSDGGRRFPFLQEGEISFGTGAGAGGVPMDQAAAAAAASVCQPLLKTVAPPPPPHGGGGSGGGKMFSDGGLTQVLDSDCALSLLSAPANSTAIDVGGGRVVVQPTEHIPMAQPLISGLQFGGGGGSSAWFAARPHHQAATGAAATAVVVSTAGFSCPVVESEQLNTVLSSNDNEMNYNGMFHVGGEGSSDGTSSSLPFSWQ

SEQ ID NO: 1232 - protein, 455 aa, Oryza sativa; identical to SEQ ID NO: 1231

SEQ ID NO: 1233 - protein, 393 aa, Oryza sativa
MATGGSGGGGGGGGGGDDVHGLKFGKKIYFEQDAAASASAAAVESSSTSSGGGGKKGKGVAAAAAPPPPLPPRCQVEGCGVDLSGVKPYYCRHKVCYMHAKEPIVVVAGLEQRFCQQCSRFHQLPEFDQEKKSCRRRLAGHNERRRKPTPGPLSSRYGRLAASFHEEPGRSRSFVVDFSYPRVPSSVRDAWPAIQPSDRMSGSIQWQGGHELHPHRSAVAGYSDHHAFSSHGGSAAGAPMLHHPAFELTSGGCLAGVATDSSCALSLLSTQPWDTTQSTSSHNRSPPMSSTASAFGGGNNPVSPSVMASNYMAASPGWNSSSRGHDGARNVHLPPPHGVVLNEVPPGSVHHGHFSGELELALQGGAPSNRPEAEHGSGSGAFSHSTNAMNWSL

SEQ ID NO: 1234 - protein, 360 aa, Oryza sativa
MEGNGCGGSGATPRGVVGMHWAPVVTSPPSPQPPFLPPAPCRPDVQMQQQGGLTCLKLGKRPCFWGGDGAGQVAQGSGGGGGGGGGGSADQGKRKEKAATAVPVVPRCQVEGCDITLQGVKEYHRRHKVCEVHAKAPRVVVHGTEQRFCQQCSRFHVLAEFDDAKKSCRRRLAGHNERRRRSNASEAMARGSAHPHGMPVLGHGFPPYGLPTSSAGALSLLSSARATGPWLMPTPDISARSSAALDELIAENRAALLSWQFFSDRQPPPAGRPTGRSPGSETAGGWHAHLQARPPPPGAGGQHENQSGHVTLDLMQATTAAGGSGAPFRPVPARPPKEGGDAGCTSDAWTPSPMEGARVV

SEQ ID NO: 1235 - protein, 373 aa, Oryza sativa
MPTPSHLKNPLCFDFRAARRVPETHAWPGLDDHPVVDGGGGGGEDAVPVVDVGAGDAAARVARAAEQWGAFLLVGHGVPAALLSRVEERVARVFSLPASEKMRAVRGPGEPCGYGSPPISSFFSKLMWSEGYTFSPSSLRSELRRLWPKSGDDYLLFCDVMEEFHKEMRRLADELLRLFLRALGLTGEEVAGVEAERRIGERMTATVHLNWYPRCPEPRRALGLIAHTDSGFFTFVLQSLVPGLQLFRRGPDRWVAVPAVAGAFVVNVGDLFHILTNGRFHSVYHRAVVNRDRDRVSLGYFLGPPPDAEVAPLPEAVPAGRSPAYRAVTWPEYMAVRKKAFATGGSALKMVSTDAAAAADEHDDVAAAADVHA

SEQ ID NO: 1236 - protein, 763 aa, Oryza sativa
MPPIPSLWIRVFFSWLLLSLPAAAAADFSHCGGCDDGDGGGGIWSTDNILQCQRVSDFLIAMAYFSIPLELLYFATCSDLFPLKWIVLQFGAFIVLCGLTHLITMFTYEPHSFHVVLALTVAKFLTALVSFATAITLLTLIPQLLRVKVRENFLRIKARELDREVGMMKRQEEASWHVRMLTHEIRKSLDRHTILYTTMVELSKTLELQNCAVWMPSESGSEMILTHQLRQMETEDSNSLSIAMDNPDVLEIKATKDAKVLAADSALGIASRGKLEAGPVAAIRMPMLKASNFKGGTPEVMETSYAILVLVLPEDGSLGWGEEELEIVEVVADQVAVALSHAAVLEESQLMREKLAAQHRDLLRAKHETTMATEARNSFQTAMYDGMRRPMHSILGLVSMMQQENMNPEQRLVMDAIVKTSSVASTLMNDVMQTSTVNREYLSLVRRAFNLHSLVKEAISVVRCLTGCKGIDFEFEVDNSLPERVVGDEKRVFHIVLHMVGTLIQRCNAGCLSLYVNTYNEKEERHNQDWMLRRANFSGSYVCVKFEIRIRESRGNLLSSSSSRRLQGPNSTSSEMGLSFNMCKKIVQMMNGNIWSVSDSKGLGETIMLALQFQLQHVTPVSGASSDLFRSAPIPNFNGLQVILVDSDDTNRAVTHKLLEKLGCLVLSVTSGIQCINSFASAESSFQLVVLDLTMRTMDGFDVALAIRKFRGNCWPPLIVALAASTDDTVRDRCQQAGINGLIQKPVTLAALGDELYRVLQNN

SEQ ID NO: 1237 - protein, 246 aa, Oryza sativa
MAIAGVLFLLFLARQASAAGYGGWQSAHATFYGGGDASGTMGGACGYGNLYSQGYGTNTAALSTALFNDGAACGSCYELRCDNAGSSCLPGSITVTATNFCPPNYGLPSDDGGWCNPPRPHFDMAEPAFLHIAQYRAGIVPVSFRRVPCVKKGGVRFTVNGHSYFNLVLVTNVAGAGDVRSVSIKGSRTGWQPMSRNWGQNWQSNAFLDGQSLSFQVTASDGRTVTSNNVAHPGWQFGQTFEGGQF

SEQ ID NO: 1238 - protein, 372 aa, Oryza sativa
MSMVVQQEQEVVFDAAVLSGQTEIPSQFIWPAEESPGSVAVEELEVALIDVGAGAERSSVVRQVGEACERHGFFLVVNHGIEAALLEEAHRCMDAFFTLPLGEKQRAQRRAGESCGYASSFTGRFASKLPWKETLSFRYSSAGDEEGEEGVGEYLVRKLGAEHGRRLGEVYSRYCHEMSRLSLELMEVLGESLGIVGDRRHYFRRFFQRNDSIMRLNYYPACQRPLDTLGTGPHCDPTSLTILHQDHVGGLEVWAEGRWRAIRPRPGALVVNVGDTFMALSNARYRSCLHRAVVNSTAPRRSLAFFLCPEMDTVVRPPEELVDDHHPRVYPDFTWRALLDFTQRHYRADMRTLQAFSDWLNHHRHLQPTIYS

SEQ ID NO: 1239 - protein, 327 aa, Oryza sativa
MVVLAGPPAVDHIPLLRSPDPGDVFSGVPVVDLGSPGAARAVVDACERYGFFKVVNHGVATDTMDKAESEAVRFFSQTQPDKDRSGPAYPFGYGSKRIGFNGDMGWLEYLLLALDDASLADACTVPSCAVFRAALNEYISGVRKVAVRVMEAMSEGLGIAQADALSALVTAEGSDQVFRVNHYPPCRALQGLGCSVTGFGEHTDPQLVSVLRSNGTSGLQIALRDGQWVSVPSDRDSFFVNVGDSLQVLTNGRFKSVKHRVVANSLKSRVSFIYFGGPPLAQRIAPLPQLLGEGEQSLYKEFTWDEYKKAAYKSRLGDNRLAQFEKK

SEQ ID NO: 1240 - protein, 358 aa, Oryza sativa; identical to SEQ ID NO: 947

SEQ ID NO: 1241 - protein, 277 aa, Oryza sativa
MKRPGGAGGGGGSPSLVTMANSSDDGYGGVGMEAEGDVEEEMMACGGGGEKKRRLSVEQVRALERSFEVENKLEPERKARLARDLGLQPRQVAVWFQNRRARWKTKQLERDYAALRHSYDSLRLDHDALRRDKDALLAEIKELKAKLGDEEAAASFTSVKEEPAASDGPPAAGFGSSDSDSSAVLNDVDAAGAAPAATDALAPEACTFLGAPPAAGAGAGAAAAASHEEVFFHGNFLKVEEDETGFLDDDEPCGGFFADDQPPPLSSWWAEPTEHWN

SEQ ID NO: 1242 - protein, 236 aa, Oryza sativa
MAGADVDVGTELRLGLPGGGGGAAEAAAKAAKRGFEETIDLKLKLPTAGMEEAAAGKAEAPAAEKAKRPAEAAAADAEKPPAPKAQAVGWPPVRSFRRNIMTVQSVKSKKEEEADKQQQQPAANASGSNSSAFVKVSMDGAPYLRKVDLKMYNSYKDLSLALQKMFGTFTATGNNMNEVNGSDAVTTYEDKDGDWMLVGDVPWQMFVESCKRLRIMKGSEAIGLAPRAKDKYKNKS

SEQ ID NO: 1243 - protein, 343 aa, Oryza sativa; identical to SEQ ID NO: 1090

SEQ ID NO: 1244 - protein, 490 aa, Oryza sativa
MVSAAAGWAAPAFAVAAVVIWVVLCSELLRRRRRGAGSGKGDAAAAARLPPGSFGWPVVGETLEFVSCAYSPRPEAFVDKRRKLHGSAVFRSHLFGSATVVTADAEVSRFVLQSDARAFVPWYPRSLTELMGKSSILLINGALQRRVHGLVGAFFKSSHLKSQLTADMRRRLSPALSSFPDSSLLHVQHLAKSVVFEILVRGLIGLEAGEEMQQLKQQFQEFIVGLMSLPIKLPGTRLYRSLQAKKKMARLIQRIIREKRARRAAASPPRDAIDVLIGDGSDELTDELISDNMIDLMIPAEDSVPVLITLAVKFLSECPLALHQLEEENIQLKRRKTDMGETLQWTDYMSLSFTQHVITETLRLGNIIGGIMRKAVRDVEVKGHLIPKGWCVFVYFRSVHLDDTLYDEPYKFNPWRWKEKDMSNGSFTPFGGGQRLCPGLDLARLEASIFLHHLVTSFRWVAEEDHIVNFPTVRLKRGMPIRVTAKEDDD

SEQ ID NO: 1245 - protein, 1121 aa, Oryza sativa
MDSLWAAIAALFVAAAVVVRGAAAADDAQLLEEFRQAVPNQAALKGWSGGDGACRFPGAGCRNGRLTSLSLAGVPLNAEFRAVAATLLQLGSVEVLSLRGANVSGALSAAGGARCGSKLQALDLSGNAALRGSVADVAALASACGGLKTLNLSGDAVGAAKVGGGGGPGFAGLDSLDLSNNKITDDSDLRWMVDAGVGAVRWLDLALNRISGVPEFTNCSGLQYLDLSGNLIVGEVPGGALSDCRGLKVLNLSFNHLAGVFPPDIAGLTSLNALNLSNNNFSGELPGEAFAKLQQLTALSLSFNHFNGSIPDTVASLPELQQLDLSSNTFSGTIPSSLCQDPNSKLHLLYLQNNYLTGGIPDAVSNCTSLVSLDLSLNYINGSIPASLGDLGNLQDLILWQNELEGEIPASLSRIQGLEHLILDYNGLTGSIPPELAKCTKLNWISLASNRLSGPIPSWLGKLSYLAILKLSNNSFSGPIPPELGDCQSLVWLDLNSNQLNGSIPKELAKQSGKMNVGLIVGRPYVYLRNDELSSECRGKGSLLEFTSIRPDDLSRMPSKKLCNFTRMYVGSTEYTFNKNGSMIFLDLSYNQLDSAIPGELGDMFYLMIMNLGHNLLSGTIPSRLAEAKKLAVLDLSYNQLEGPIPNSFSALSLSEINLSNNQLNGTIPELGSLATFPKSQYENNTGLCGFPLPPCDHSSPRSSNDHQSHRRQASMASSIAMGLLFSLFCIIVIIIAIGSKRRRLKNEEASTSRDIYIDSRSHSATMNSDWRQNLSGTNLLSINLAAFEKPLQNLTLADLVEATNGFHIACQIGSGGFGDVYKAQLKDGKVVAIKKLIHVSGQGDREFTAEMETIGKIKHRNLVPLLGYCKAGEERLLVYDYMKFGSLEDVLHDRKKIGKKLNWEARRKIAVGAARGLAFLHHNCIPHIIHRDMKSSNVLIDEQLEARVSDFGMARLMSVVDTHLSVSTLAGTPGYVPPEYYQSFRCTTKGDVYSYGVVLLELLTGKPPTDSADFGEDNNLVGWVKQHTKLKITDVFDPELLKEDPSVELELLEHLKIACACLDDRPSRRPTMLKVMAMFKEIQAGSTVDSKTSSAAAGSIDEGGYGVLDMPLREAKEEKD

SEQ ID NO: 1246 - protein, 725 aa, Oryza sativa
MEINSSGEEAVVKVRKPYTITKQRERWTEAEHNRFLEALKLYGRAWQRIEEHVGTKTAVQIRSHAQKFFTKLEKEAINNGTSPGQAHDIDIPPPRPKRKPNSPYPRKSCLSSETSTREVQNDKATISNMTNNSTAQMAGDAALEKLTYIQKLQRKEISEKGSCSEVLNLFREVPSASFSSVNKSSSNHGASRGLEPTKTEVKDVVILERDSISNGAGKDAKDINDQEMERLNGIHISSKPDHSHENCLDTSSQQFKPKSNSVETTYVDWSAAKASHYQMDRNGVTGFQATGTEGSHPDQTSDQMGGASGTMNQCIHPTLPVDPKFDGNAAAQPFPHNYAAFAPMMQCHCNQDAYRSFANMSSTFSSMLVSTLLSNPAIHAAARLAASYWPTVDGNTPDPNQENLSESAQGSHAGSPPNMASIVTATVAAASAWWATQGLLPLFPPPIAFPFVPAPSAPFSTADVQRAQEKDIDCPMDNAQKELQETRKQDNFEAMKVIVSSETDESGKGEVSLHTELKISPADKADTKPAAGAETSDVFGNKKKQDRSSCGSNTPSSSDIEADNAPENQEKANDKAKQASCSNSSAGDNNHRRFRSSASTSDSWKEVSEEGRLAFDALFSRERLPQSFSPPQVEGSKEISKEEEDEVTTVTVDLNKNAAIIDQELDTADEPRASFPNELSNLKLKSRRTGFKPYKRCSVEAKENRVPASDEVGTKRIRLESEAST

SEQ ID NO: 1247 - protein, 1426 aa, Oryza sativa
MWAAEAAFARSGSWREEEDEQEALRWAALQRLPTVARARRGLLRSPAPGEDRVQGDDALCEVDVAGLSPGDRTALVDRLLADSGDVEDFFRRIRSRFDAVQIEFPKIEVRYEDLTVDAYVHVGSRALPTIPNFICNMTEAFLRHLRIYRGGRVKLPILDNVSGIIRPSRMTLLLGPPSSGKTTLLLALAGRLGPGLKVSGNITYNGHHLNEFVPQRTSAYVSQQDWHASEMTVRETLEFAGRCQGVGIKYDMLVELLRREKNEGIKPDEDLDVFMKALALEGKQTSLVAEYIMKILGLDICADTIVGDEMIKGISGGQKKRLTTGELLVGSARVLFMDEISTGLDSATTYQIIKYLRHSTHALDGTTIISLLQPAPETYELFDDVILISEGQIVYQGPREYAVDFFAGMGFRCPERKNVADFLQEVLSKKDQQQYWCHYDYPYQYVSVSKFAEAFKTFVIGKRLHDELAVPYNRHRNHPAALSTSNYGVRRLELLKSNFQWQHLLMKRNSFIYVFKFIQLLLVALITMTVFFRSTMHRDSVDDGIIYLGALYFAIVMILFNGFTEVSLLVTKLPILYKHRDLHFYPPWAYTLPSWLLSIPTSLIESGMWVLVTYYVVGYDPQFTRCLGQFLLLFFLHQTSLALFRVMASLGRNMIVANTFGSFALLVVMILGGFIITKESIPAWWIWGYWISPMMYAQNAISVNEFLGHSWSQQFANQNITLGEAILTGYGLFKEKYWFWIGVGALFGYAIVLNFLFTLFLTLLNPIGNIQAVVSKDDIQHRAPRRKNGKLALELRSYLHSASLNGHNLKDQKGMVLPFQPLSMCFKNINYYVDVPAELKSQGIVEDRLQLLIDVTGAFRPGILTALVGVSGAGKTTLMDVLAGRKTGGLIEGSITISGYPKNQETFTRISGYCEQNDVHSPCLTVIESLLYSACLRLPSHVDVNTRRVFVEEVMELVELNALSGALVGLPGVNGLSTEQRKRLTIAVELVANPSIVFMDEPTSGLDARSAAIVMRTVRNIVNTGRTIVCTIHQPSIDIFESFDELLFMKRGGQLIYAGPLGSKSRNLVEFFEAIPGVPKIRDGYNPAAWMLEVTSTQMEQILGVDFAEYYRQSKLFQQTQEMVDILSRPRRESKELTFATKYSQPFFAQYAACLWKQNLSYWRNPQYTAVRFFYTVIISLMFGTICWKFGSRRETQHDIFNAMGAMYAAVLFIGITNATSVQPVISIERFVSYRERAAGMYSALPFAFSLVTVEFPYILVQSLIYGTIFYSLGSFEWTAVKFLWYLFFMYFTLLYFTFYGMMTTAITPNHTVAPIIAAPFYTLWNLFCGFMIPRKRIPAWWRWYYWANPVSWTLYGLLTSQFGDLDQPLLLADGITTTTAVDFLRDHFGFRHDFLGVVAGMVAGFCVLFAVVFALAIKYLNFQRR

SEQ ID NO: 1248 - protein, 309 aa, Oryza sativa
MAIPVIDFSKLDGDESEATLAELAAGFEEWGFFQLVNTGIPDDLLERVKKVCSDIYKLREDGFKESNPAVKALARLVDQEGEGLAMKKIEDMDWEDVFTLQDDLPWPSNPPSFKETMMEYRRELKKLAEKLLGVMEELLGLEEGHIRKAFTNDGDFEPFYGTKVSHYPPCPRPELVDGLRAHTDAGGLILLFQDDRFGGLQMIPNRGGDGRWIDVQPVENAIVVNTGDQIEVLSNGRFKSAWHRILATRDGNRRSIASFYNPARMANIAPAIPAAAADYPSFKFGDYMEVYVKQKFQAKEPRFAALANK

SEQ ID NO: 1249 - protein, 215 aa, Oryza sativa
MAPVVSALAKYKLVFLGDQAVGKTAIITRFMYDKFDATYQATIGIDFLSKTMYLEDRTVRLQLWDTAGQERFRSLIPSYIRDSSVAVIVYDVTDRQSFLSISKWIEEVNTQRGGDVIIVLVGNKTDLVDKRQISTDEGEAKAQEHGAMFMETSAKAGFNIKPLFRKIAASLPGMEALSSAKQEDMVDINLRPAASGQIPSGAEAQEEQKAGGCSC

SEQ ID NO: 1250 - protein, 171 aa, Oryza sativa; identical to SEQ ID NO: 1169

SEQ ID NO: 1251 - protein, 564 aa, Oryza sativa
MDHGGQVSPVPATATAPRKVRREHMRLGVYHDVLQRLRDAGAPEALAPDFAEKLWTHFHRFNASYAMDVNVERAEDVLMHMKLLEKAIHPENQPAFSVRIVQVPLDIDASEADSQSNITEDDNCPTPRTPAEHPAPIFGSTTALKALVRQASSKNLLDDNQDIDAILRPMHEITFASDDKPKGLTQLSSLLGNLNLDIKEVHALSTNDGYFLDIFIVIGWDHKETQLLEEALEKEIHNYEPQMPSKSSCWPPELAGKQSLINSQVNHVQIPKDNTDEWEINFDVLDIQEKVASGTYGDLYRGTYFGEDVAIKVLKSDRLNENMQEEFNEEVFIMRKIRHKNIVRFLGACTKSPTLCIVTEFMKNGSVYDYLHKRKGSFKLPSLLKAAVDISKGMNYLHQNKIIHRDLKTANLLMDEHELIKVADFGVARVKAESGIMTAETGTYRWMAPEVIEHKPYDSKADVFSFGVVLWELLTGKIPHEFLTPLQAAIGVVQEGLRPVIPKATDPKLALLLESCWQQNAVNRPDFVQILQKLDEIAGEHGIDLTHPHKEKEKGGFFTFGKVH

SEQ ID NO: 1252 - protein, 624 aa, Oryza sativa
MAAHRWAVWAVLLLRLLVPAARVLANMEGDALHSLRTNLVDPNNVLQSWDPTLVNPCTWFHVTCNNDNSVIRVDLGNAALSGTLVPQLGQLKNLQYLELYSNNISGTIPSELGNLTNLVSLDLYLNNFTGPIPDSLGNLLKLRFLRLNNNSLSGSIPKSLTAITALQVLDLSNNNLSGEVPSTGSFSLFTPISFANNPSLCGPGTTKPCPGAPPFSPPPPYNPPTPVQSPGSSSSTGAIAGGVAAGAALLFAIPAIGFAWYRRRKPQEHFFDVPAEEDPEVHLGQLKRFSLRELQVATDTFSNKNILGRGGFGKVYKGRLADGSLVAVKRLKEERTPGGELQFQTEVEMISMAVHRNLLRLRGFCMTPTERLLVYPYMANGSVASRLRERPPSEPPLDWRTRRRIALGSARGLSYLHDHCDPKIIHRDVKAANILLDEDFEAVVGDFGLAKLMDYKDTHVTTAVRGTIGHIAPEYLSTGKSSEKTDVFGYGIMLLELITGQRAFDLARLANDDDVMLLDWVKGLLKEKRLEMLVDPDLQSNYIDVEVESLIQVALLCTQGSPTERPKMAEVVRMLEGDGLAERWEEWQKIEVVRQEVELGPHRNSEWIVDSTDNLHAVELSGPR

SEQ ID NO: 1253 - protein, 480 aa, Oryza sativa
MVGGELVLAALVILLALLLTLVLSHFLPLLLNPKAPKGSFGWPLLGETLRFLSPHASNTLGSFLEDHCSRYGRVFKSHLFCTPTIVSCDQELNHFILQNEERLFQCSYPRPIHGILGKSSMLVVLGEDHKRLRNLALALVTSTKLKPSYLGDIEKIALHIVGSWHGKSKDKGMVNVIAFCEEARKFAFSVIVKQVLGLSPEEPVTAMILEDFLAFMKGLISFPLYIPGTPYAKAVQARARISSTVKGIIEERRNAGSSNKGDFLDVLLSSNELSDEEKVSFVLDSLLGGYETTSLLISMVVYFLGQSAQDLELVKREHEGIRSKKEKDEFLSSEDYKKMEYTQHVINEALRCGNIVKFVHRKALKDVRYKEYLIPSGWKVLPVFSAVHLNPLLHGNAQQFQPCRWEGASQGTSKKFTPFGGGPRLCPGSELAKVEAAFFLHHLVLNYRWRIDGDDIPMAYPYVEFQRGLPIEIEPLCSES

SEQ ID NO: 1254 - protein, 276 aa, Oryza sativa
MTGSSCPADSSQLLYPRRGAPTTTTTSRPPLHPLIAHAPYDVVLHRSVVLSISSARDQAELASFWCYIRLGGGASAKRAAGEDDRSRSSLTAARGGGGETMSGRGRGDPLVLGRVVGDVVDPFVRRVALRVAYGAREVANGCELRPSAVADQPRVAVGGPDMRTFYTLVMVDPDAPSPSDPNLREYLHWLVTDIPATTGVSFGTEVVCYESPRPVLGIHRLVFLLFEQLGRQTVYAPGWRQNFSTRDFAELYNLGLPVAAVYFNCQRESGTGGRRM

SEQ ID NO: 1255 - protein, 203 aa, Oryza sativa
MPQTPSTRWCPTPEQLMILEEMYRSGVRTPNAAEIQQITAHLAYYGRIEGKNVFYWFQNHKARERQRLRRRLCARHQQQPSPPSSTVPPAPTAAAAGAVVQVHPAVMQLHHHHHHHHPYAAAAAAQSHHLQQQQQQQAEWPAAVDYCSTASASASATAADMAIPPCCRPLKTLELFPTKSTSGGLKEDCCSSSKSSSCSTSTN

SEQ ID NO: 1256 - protein, 234 aa, Oryza sativa
MPQTPSTRWCPTPEQLMILEEMYRSGVRTPNAAEIQQITAHLAYYGRIEGKNVFYWFQNHKARERQRLRRRLCARHQQQPSPPSSTVPPAPTAAAAGAVVQVHPAVMQLHHHHHHHHPYAAAAAAQSHHLQQQQQQQAEWPAAVDYCSTASASASATAADMAIPPCCRPLKTLELFPTKSTSGGLKEDCCSSSKPWARSVVESLGGRERSSLAVVDSGGDMDGIERRRRELGER

SEQ ID NO: 1257 - protein, 863 aa, Oryza sativa [sequence omitted]

SEQ ID NO: 1258 - protein, 468 aa, Oryza sativa
MELHRCSLLALLLAVTCSVAVAYDPLDPKGNITIKWDVISWTPDGYVAMVTMSNYQMYRQILAPGWTVGWSWAKKEVIWSIVGAQATEQGDCSKFKGGIPHSCKRTPAIVDLLPGVPYNQQIANCCKAGVVSAYGQDPAGSVSAFQVSVGLAGTTNKTVKLPTNFTLAGPGPGYTCGPATIVPSTVYLTPDRRRRTQALMTWTVTCTYSQQLASRYPTCCVSFSSFYNSTIVPCARCACGCGHDGYRGNGGGGKNARAGDGRSRRNSGGGGGHSGGTECIMGDSKRALSAGVNTPRKDGAPLLQCTSHMCPIRVHWHVKLNYKDYWRAKIAITNFNYRMNYTQWTLVAQHPNLNNVTEVFSFQYKPLLPYGNINDTGMFYGLKFYNDLLMEAGPFGNVQSEVLMRKDYNTFTFSQGWAFPRKIYFNGDECKMPPPDSYPYLPNSAPIGPPRSVAAAASAILVVLLLVA

SEQ ID NO: 1259 - protein, 388 aa, Oryza sativa
MLPFFDSPSPMDIPLYQQLQLTPPSPKPDHHHHHHSTFFYYHHHPPPSPSFPSFPSPAAATIASPSPAMHPFMDLELEPHGQQLAAAEEDGAGGQGVDAGVPFGVDGAAAAAAARKDRHSKISTAGGMRDRRMRLSLDVARKFFALQDMLGFDKASKTVQWLLNMSKAAIREIMSDDASSVCEEDGSSSLSVDGKQQQHSNPADRGGGAGDHKGAAHGHSDGKKPAKPRRAAANPKPPRRLANAHPVPDKESRAKARERARERTKEKNRMRWVTLASAISVEAATAAAAAGEDKSPTSPSNNLNHSSSTNLVSTELEDGSSSTRHNGVGVSGGRMQEISAASEASDVIMAFANGGAYGDSGSYYLQQQHQQDQWELGGVVYANSRHYC

SEQ ID NO: 1260 - protein, 91 aa, Oryza sativa
MVRVGAAAAVLVLAAAAAAMAAEPPTDDGAVRVAAGLTKCVSGCGSKVTSCLLGCYGGGGGAAAAATAMPFCVIGCTSDVLSCATGCSTSL

SEQ ID NO: 1261 - protein, 254 aa, Oryza sativa
MAPAASASASAVVTPSSFRCVPTASCGLGARGKAPAPRRLLHDHAQGKKRAAATWSLKAGLWDSLRSGFLKSNNSTETVEPPSAPIEEEEPLPEELVLLERTLADGSTEQIIFSSAGDVNVYDLQALCDKVGWPRRPLTKIAASLRNSYLVATLHSVTMPSKAEGEERKQLIGMARATSDHAFNATIWDVLVDPSYQGQGLGKALMEKVIRTLLQRDISNITLFADNKVVDFYKNLGFEADPQGIKGMFWYPRF

SEQ ID NO: 1262 - protein, 1082 aa, Oryza sativa
MAFQLDNGYYSHQALAMMRKKKTEPRNAGESSGTQQATGAPGRGPSQRPERAQQHGGGGWQPANPQYAQQAGRGGGQHQGRGGRYQGRGGPTSHQPGGGPVEYQAHEYYGRGVQRQGGMPQHRSGSGGHGVPASPSRTVPELHQASQDQYQATVVAPSPSRTGPSSLPVEASSEEVQHQFQELAIQGQSPTSQAIQPAPPSSKSVRFPMRPGKGTFGDRCIVKANHFFAELPDKDLHQYDVSITPEVPSRGVNRAVIGEIVTQYRQSHLGGRLPVYDGRKSLYTAGPLPFTSRTFDVILQDEEESLAVGQGAQRRERPFKVVIKFAARADLHHLAMFLAGRQADAPQEALQVLDIVLRELPTARYSPVARSFYSPNLGRRQQLGEGLESWRGFYQSIRPTQMGLSLNIDMSSTAFIEPLPVIDFVAQLLNRDISVRPLSDADRVKIKKALRGVKVEVTHRGNMRRKYRISGLTSQATRELSFPIDNHGTVKTVVQYFQETYGFNIKHTTLPCLQVGNQQRPNYLPMEVCKIVEGQRYSKRLNEKQITALLKVTCQRPQERELDILQTVHHNAYHQDPYAQEFGIRIDERLASVEARVLPPPWLKYHDSGREKDVLPRIGQWNMMNKKMVNGGRVNNWTCINFSRHVQDNAARSFCRELAIMCQISGMDFSIDPVVPLVTARPEHVERALKARYQEAMNILKPQGGELDLLIAILPDNNGSLYGDLKRICETDLGLVSQCCLTKHVFKMSKQYLANVALKINVKVGGRNTVLVDALTRRIPLVSDRPTIIFGADVTHPHPGEDSSPSIAAVVASQDWPEVTKYAGLVSAQAHRQELIQDLFKVWKDPQRGTVSGGMIRELLISFKRATGQKPQRIIFYRDGVSEGQFYQVLFYELDAIRKACASLEADYQPPVTFVVVQKRHHTRLFANNHKDQRTVDRSGNILPGTVVDSKICHPTEFDFYLCSHAGIQGTSRPAHYHVLWDENKFTADGLQTLTNNLCYTYARCTRSVSIVPPAYYAHLAAFRARFYMEPDTSDSGSMASGAHTRGGGPLPGARSTKPAGNVAVRPLPDLKENVKRVMFYC

SEQ ID NO: 1263 - protein, 1118 aa, Oryza sativa
MALQLENGRPHHHQVPIMVKKKRTGSGSTGESSGEAPGAPGHGSSQRAERGPQQHGGGRGWVPQHGGRGGGQYQGRGGHYQGRGGQGSHHPGGGPPEYQGRGGPGSHHPGGGPPDYQGRGGSGSHHPGGGPPEYQPRDYQGRGGPRPRGGMPQPYYGGPRGSGGRSVPSGSSRTVPELHQAPHVQYQAPMVSPTPSGAGSSSQPAAEVSSGQVQQQFQQLATRDQSSTSQAIQIAPPSSKSVRFPLRPGKGTYGDRCIVKANHFFAELPDKDLHQYDVSITPEVTSRGVNRAVMFELVTLYRYSHLGGRLPAYDGRKSLYTAGPLPFASRTFEITLQDEEDSLGGGQGTQRRERLFRVVIKFAARADLHHLAMFLAGRQADAPQEALQVLDIVLRELPTTRYSPVGRSFYSPNLGRRQQLGEGLESWRGFYQSIRPTQMGLSLNIDMSSTAFIEPLPVIDFVAQLLNRDISVRPLSDSDRVKIKKALRGVKVEVTHRGNMRRKYRISGLTSQATRELSFPVDDRGTVKTVVQYFLETYGFSIQHTTLPCLQVGNQQRPNYLPMEVCKIVEGQRYSKRLNEKQITALLKVTCQRPQERELDILRTVSHNAYHEDQYAQEFGIKIDERLASVEARVLPPPRLKYHDSGREKDVLPRVGQWNMMNKKMVNGGRVNNWACINFSRNVQDSAARGFCHELAIMCQISGMDFALEPVLPPLTARPEHVERALKARYQDAMNMLRPQGRELDLLIVILPDNNGSLYGDLKRICETDLGLVSQCCLTKHVFKMSKQYLANVALKINVKVGGRNTVLVDALTRRIPLVSDRPTIIFGADVTHPHPGEDSSPSIAAVVASQDWPEVTKYAGLVSAQAHRQELIQDLFKVWQDPHRGTVTGGMIKELLISFKRATGQKPQRIIFYRDGVSEGQFYQVLLYELDAIRKACASLEPNYQPPVTFVVVQKRHHTRLFANNHNDQRTVDRSGNILPGTVVDSKICHPTEFDFYLCSHAGIQGTSRPAHYHVLWDENKFTADELQTLTNNLCYTYARCTRSVSIVPPAYYAHLAAFRARFYMEPETSDSGSMASGAATSRGLPPGVRSARVAGNVAVRPLPALKENVKRVMFYC

SEQ ID NO: 1264 - protein, 1011 aa, Oryza sativa
MASRRPTHRHHTEAPDPGGRGRGRGRAARYAQPQPQPQQQQQQQGRGCRARGASPPPPPQQQQQQQPRSTPTRATTVTVASSSSTTATASSSPLAPELRQAIMEAPRPSELAQPSPTPPQEQPVDAATTTPHHIPSSSKSIRFPLRPGKGTIGTRCMVKANHFFAHLPNKDLHHYDVSITPEVTSRIVNRAVIKELVNLYKASYLGGRLPAYDGRKSLYTAGPLPFTSQEFQITLLDDDDGSGSERRQRTFRVVIKFAARADLHRLELFLAGRHAEAPQEALQVLDIVLRELPSARYAPFGRSFFSPYLGRRQPLGEGLESWRGFYQSIRPTQMGLSLNIDMSATAFIEPLPVIDFVAQLLNSDIHSRPLSDAERVKIKKALRGVKVEVTHRGNMRRKYRISGLTIQPTRELTFPVDEGGTVKSVVQYFQETYGFAIQHTYLPCLTVQRLNYLPMEVCKIVEGQRYSKRLNQNQIRALLEETCQHPRDRERDIIKMVKHNAYQDDPYAKEFGIKISDRLASVEARILPAPRLKYNETGREKDCLPRVGQWNMMNKKMVNGGKVRSWMCVNFARNVQESVVRGFCHELALMCQASGMDFAPEPILPPLNAHPDQVERALKARYHDAMNVLGPQRRELDLLIGILPDNNGSLYGDLKRVCEIDLGIVSQCCCTKQVFKMNKQILANLALKINVKVGGRNTVLVDAVSRRIPLVTDRPTIIFGADVTHPHPGEDSSPSIAAVVASQDWPEVTKYAGLVSAQAHRQELIEDLYKIWQDPQRGTVSGGMIRELLISFKRSTGEKPQRIIFYRDGVSEGQFYQVLLYELNAIRKACASLETNYQPKVTFIVVQKRHHTRLFAHNHNDQNSVDRSGNILPGTVVDSKICHPTEFDFYLCSHAGIKGTSRPAHYHVLWDENNFTADALQILTNNLCYTYARCTRSVSIVPPAYYAHLAAFRARFYMEPDTSDSSSVVSGPGVRGPLSGSSTSRTRAPGGAAVKPLPALKDSVKRVMFYC

SEQ ID NO: 1265 - protein, 990 aa, Oryza sativa
MAPARPPRPARPPEPASPPPPPPPPAPASPPPPPAPAAKGIQDEGSSSSSWSVERIPYGEDEKEEPPATPIASSNKNKREEPPTKHRPMARPPGGGGPLSKGEVKLLVNHFSVDYPKESTFFHYEIRIKLGDGPNRKLSKAELLTVKNELFEHESLQELSSAVAYDGERNLYTCAELPEDCIVPVSKFRVKDSSRTYIVSVKLKKPLPLSQLLEQRPGPRDVMQGLDVIVREASSFGKIVLGQGFYPQSGSEAISDSNIVALKGTQQSLKCTQKGLILCVDYSVLPCWKAGSVLDLVKTMKFMEYPLLEDQLKKLNNALKGLCVTVSHRKTEEKYTVKGLTDKPADQITFKDSKSGQTTKLIEYYKETYKKEIEHPMLPCLDLSKSKSKQNYVPIEFCNIPEGERYPVARLDDKKSDNKGEQEKPSTKTTLRKISIKVASSRKEEILDLVGNAQDGPCRGKIAQRFRISLDAAMMEVTGRILAPPTLELGTGTSRGQTFKFTIHQDDCQWNWKLKKYDKRVVAHGGTLNCWGVVDFSEGDLESKFIDKVVRKCSALGMVMTRKPCYEHVSNMEVLSDPKSLRDALIEAKRAAEEEDKKLQLLFCPMLNRCHGYKTLKLMCETELGIQTQCFLSTAAKLDEKRQDQYITNLALKINGKIGGSNMQLDPDSIPVVSAKDFMFIGADVNHPPPGNVSKDIPSIAAVVASVDKGASKYVTRIRAQYHRCEMIQNLGDICKELIGAYEKVNKKKPDSIIYFRDGVSDGQFDMVLNEELADMENKIMVGDYPKITVIVAKKRHHTRLFPKDRNQRQTKNGNVLPGTVVDTDVVDPTAYDFYLCSHKGEVGTSRPTHYYSLLDEHGFASDDLQKLVYNLCFVFARCTKPVSLATPVYYADLAAYRGRLYYEGMMMLQPAASAASASEAMMPAAQPQAAAAAAAAASPSSSAASSSEGMTASQPQAPAAEAASSSAGAADFRELPPMHGDLLNNMFFL

SEQ ID NO: 1266 - protein, 211 aa, Oryza sativa
MDEEKEADSPQPPSKLPRLSGADPNAGVVTMAAPPPPVGLGLGLGLGGDSRGERDVEASAAAAHKATALTFMQQQELEHQVLIYRYFAAGAPVPVHLVLPIWKSVASSSFGPHRFPSLAVMGLGNLCFDYRSSMEPDPGRCRRTDGKKWRCSRDVVPGHKYCERHVHRGRGRSRKPVEASAAATPANNGGGGGIVFSPTSVLLAHGTARAT

SEQ ID NO: 1267 - protein, 387 aa, Oryza sativa
MAMPFASLSPAADHRPSFIFPFCRSSPLSAVGEEAQQHMMGARWAAAVARPPPFTAAQYEELEQQALIYKYLVAGVPVPADLLLPIRRGLDSLASRFYHHPVLGYGSYFGKKLDPEPGRCRRTDGKKWRCSKEAAPDSKYCERHMHRGRNRSRKPVEAQLVAPHSQPPATAPAAAVTSTAFQNHSLYPAIANGGGANGGGGGGGGGGSAPGSFALGSNTQLHMDNAASYSTVAAGAGNKDFRYSAYGVRPLADEHSPLITGAMDTSIDNSWCLLPSQTSTFSVSSYPMLGNLSELDQNTICSLPKVEREPLSFFGSDYVTVDSGKQENQTLRPFFDEWPKARDSWPDLADDNSLATFSATQLSISIPMATSDFSTTSSRSHNGIYSR

SEQ ID NO: 1268 - protein, 356 aa, Oryza sativa
MLSSSPSAAAPGIGGYQPQRGAAVFTAAQWAELEQQALIYKYLVAGVPVPGDLLLPIRPHSSAAATYSFANPAAAPFYHHHHHPSLSYYAYYGKKLDPEPWRCRRTDGKKWRCSKEAHPDSKYCERHMHRGRNRSRKPVESKTAAPAPQSQPQLSNVTTATHDTDAPLPSLTVGAKTHGLSLGGAGSSQFHVDAPSYGSKYSLGAKADVGELSFFSGASGNTRGFTIDSPTDSSWHSLPSSVPPYPMSKPRDSGLLPGAYSYSHLEPSQELGQVTIASLSQEQERRSFGGGAGGMLGNVKHENQPLRPFFDEWPGRRDSWSEMDEERSNQTSFSTTQLSISIPMPRCGSPIGPRLP

SEQ ID NO: 1269 - protein, 196 aa, Oryza sativa
MDLVSPSEHLCYVRCTYCNTVLALQVGVPCKRLMDTVTVKCGHCNNLSFLSPRPPMVQPLSPTDHPLGPFQGPCTDCRRNQPLPLVSPTSNEGSPRAPFVVKPPEKKHRLPSAYNRFMREEIQRIKAAKPDIPHREAFSMAAKNWAKCDPRCSSTVSTSNSNPEPRVVAAPIPHQERANEQVVESFDIFKQMERSG

SEQ ID NO: 1270 - protein, 426 aa, Oryza sativa
MGEEAVVMEAPRPKSPPRYPDLCGRRRMQLEVQILSREITFLKDELHFLEGAQPVSRSGCIKEINEFVGTKHDPLIPTKRRRHRSCRLFRWIGSKLCICISCLCYCCKCSPKCKRPRCLNCSCSSCCDEPCCKPNCSACCAGSCCSPDCCSCCKPNCSCCKTPSCCKPNCSCSCPSCSSCCDTSCCKPSCTCFNIFSCFKSLYSCFKIPSCFKSQCNCSSPNCCTCTLPSCSCKGCACPSCGCNGCGCPSCGCNGCGCPSCGCNGCGLPSCGCNGCGSCSCAQCKPDCGSCSTNCCSCKPSCNGCCGEQCCRCADCFSCSCPRCSSCFNIFKCSCAGCCSSLCKCPCTTQCFSCQSSCCKRQPSCCKCQSSCCEGQPSCCEGHCCSLPKPSCPECSCGCVWSCKNCTEGCRCPRCRNPCCLSGCLC

SEQ ID NO: 1271 - protein, 404 aa, Oryza sativa
MATTSSLALPLFAGGGGSDRLSQEIFSILESNFLFGAPPPEGPAGYYSSVGRVRVLSIDGGADGGALAAAALVRLERRLKELSGNPDARVADYFDLAAGSGAGGFLAAALFACRMPAEAARDVVARNRKVFSGRRGRGGGLFWRPESVFKKVFGDLTVRDAAKPLLIPCYDMATAAPFVFSRADAVEADAFDFPLWQVCAAACGVGPAEVASLDGRTRLRAAAATGGGGAVSNPAAVAVTHVLHNKREFPFAAGAGDLVVLSLGGNNAAAGPRASSSSLLRIAGACQADMVDQAVSMAFGECRATNYIRIQGNGIVAGAAAATAEAAMTERSVESVLFRGKKVMAQTNGERLDGVAEQLVREHHRRMESKAPVVLIKPSATPRTSSSSASTLITVSTNASSESP

SEQ ID NO: 1272 - protein, 426 aa, Oryza sativa; identical to SEQ ID NO: 1270

SEQ ID NO: 1273 - protein, 1365 aa, Oryza sativa
MEPDAPLDFALFQLSPRRSRCELVVSGNGRTERIASGSVKPFVAHLRAAEEQAAAQPPPPAIRLQLDRRAAWFSKGTLERFVRFVSTPEVLEMANTFDAEMSQLEGARKIYAQGVAGGADGAESAAAADITKKELLRAIDVRLSALKQDLVTACARASSAGFNPDSVSELVLFADHFGANRLSEACNKFMSLCQRRPDICPHYSVSSTSSQWKSFDDGNVRGSSSSDMSLDETQADQGASSNKSIIGGSVSHIHRSNSQNSVDVPPEPSAVQHPKPTIQQSVEKQEKETDALPAPAPAGGGSRRLSVQDRINMFESKQKEQTSSSGNSAACTSKVVPTKGEHRRVPSGASMDKLVRRWSNVSDMSIDLSNNDSSSLNEKREIGTPVGTPTSANLEVNSKARADGDANGLKHAVTSCQKDTSDALPLDSTTADAFSSSTLNTTSPSPLSAIASSSPQKQTAPRVEDDMVITSSIESESSFRKEVGASQGKGDVRMSGQAVSSVSTRARVKTSPRPTWPENNVTLSSPPLSQEHVQMTDEETIPIVHEVAVKKEQIVQKDNRGSRLRSKEIHAEADVVGRKDRPSRTTGKISDTRTRATSNPRANFRGSSVRDEAASTEAEVHDVNLQRKSLARKVEDSGRKVAAGSEILPQSDCSIHQGTNLSRQSSSAEQELSLHGGKVKLISDGNAVPLEQTKRPTKGSQDRHDELQKKANELEKLFAAQKLTSSRRGKSTDVQVENTPRVNEVKPPLVLPERIYTKQIVKESITNEFDANELLKMVDTEGYNNNVPQSIISLEESRGKFYDQYMQKRDAKLKEDWKLQGEQKEATIKAMRDSLERSNAEMRAKFSRSSSVPDSTYISRCAHKFPPLQSVIKDKDQGIDSFLVEEEMNSDYLSGDGSSRSADSRKHFSNKVACNQKKSIAPVHRHSSRTVSSGYANRRNLPDNPLAQSVPNFADLRKENTKPSAGLSRAAPRTQPKSFIRSKSIIEESKNISKDQSRKSQSMRKNLSPGELRDATSMNDVIYNWAPSKISNDQVEGVFAYITHTAGSTKSFLRKGNEAHPAVGIAGFAPPMFANTYQNGDDDDFLDQEEDSPDETKDEEYESIEENLRESDFPADSDSENPGISHEFGNSDDPGSENGDVSFPSDAPTLGGSKFNAFAGNMHDTPGEVPASWSTRPHLFAYANDNSDGDAFADSPNGSPSPWNSHTLDQITDADVSRMRKKWGSAQMPFVGPNASQQPRKDVTKGFKKLLKFGRKTRGADGLNDWVSASTASECDDDMEDGRDLAMGSSDDFRKSRMGYPSAYDGFVDTDVFAEQDQSLRSSIPNPPANFRLREDQLTGSSLKAPRSFFSLSTFRSKGGDARLR

SEQ ID NO: 1274 - protein, 515 aa, Oryza sativa
MPLPSLLLPSPPPPLSLSAPSISLSPLSLSLSLSDLQSRSPEARLRLPSLLLLLQRAASEQPRRPPPPPPRPDGGGAGGAPSSGASPPNLGRNRIEGSCVSYCAVRWMLAMGSEEWELYPSSFIGAQVIDYGHVSGDMDDDQSGDLAVSMDAVLPDDLLEKVLSFLPVASVIRSGSVCKRWHEIVHARRQTWSKMVPQKPWYFMFTCSEEAVSGFTYDPSLRKWYGFDFPCIEKTTWSISSSSGLVCLMDSEDRSRIIVCNPITKDWKRLVDAPGGKSADYSALAISVTRTSHQYMVAVARCNQVPSEYYQWEFTIHLYESEINTWVSPFTELLIGWRGGDECVICDGVLYYLVYSTGVLVNNNEHRHCLLMYDLSTRPTHTSLMSMAIPVPCPLTCGRLMNLNERLVLVGGIGKQDRPGIIKGIGIWELRNKEWHEVARMPHKFFQGFGEFDDVFASCGADDLIYIQSYGSPALLTFELNQKLWKWSLKSPVTKRFPLQLFTGFSFEPRLDIAS

SEQ ID NO: 1275 - skipped

SEQ ID NO: 1276 - protein, 116 aa, Oryza sativa
MRTAATPPLAAAAAAVAAVFLSALLLASASASASRLPPPRRLLPLVGGEVAVAVVAGEEEKVRLGSSPPSCYSKCYGCSPCVAVQVPTLSAPSVPAAAAPRTTPRRSWRRSPTTSR

SEQ ID NO: 1277 - protein, 574 aa, Oryza sativa
MEETPLPSGKNFRSQLAAAARSINWTYAIFWSISTSRPGVLTWKDGFYNGEIKTRKITNSMNLMADELVLQRSEQLRELYDSLLSGECGHRARRPVAALLPEDLGDTEWYYVVCMTYAFGPRQGLPGKSFASNEFVWLTNAQSADRKLFHRALIAKSASIKTIVCVPFIMHGVLELGTTDPISEDPALVDRIAASFWDTPPRAAFSSEAGDADIVVFEDLDHGNAAVEATTTTVPGEPHAVAGGEVAECEPNSDNDLEQITMDDIGELYSLCEELDVVRPLDDDSSSWAVADPWSSFQLVPTSSPAPDQAPAAEATDVDDVVVAALDSSSIDGSCRPSPSSFVAWKRTADSDEVQAVPLISGEPPQKLLKKAVAGAGAWMNNGDSSAAAMTTQGSSIKNHVMSERRRREKLNEMFLILKSVVPSIHRVDKASILAETIAYLKELEKRVEELESSSQPSPCPLETRSRRKCREITGKKVSAGAKRKAPAPEVASDDDTDGERRHCVSNVNVTIMDNKEVLLELQCQWKELLMTRVFDAIKGVSLDVLSVQASTSDGLLGLKIQAKFASSAAVEPG

SEQ ID NO: 1278 - protein, 358 aa, Oryza sativa
MSEVSVMAEVEETAAAAPLDLPPGFRFHPTDEEIVSHYLTPKALNHRFSSGVIGDVDLNKCEPWHLPAMAKMGEKEWYFFCHKDRKYPTGTRTNRATESGYWKATGKDKEIFRGRGILVGMKKTLVFYLGRAPRGEKTGWVMHEFRLEGKLPSQLPRSAKDQWAVCKVFNKELALAAKNGPMAVTEATADDAGIERVGSFSFLSDFIDPAELPPLMDPSFVADIDGVDDAKVSASTSGQAAIAAGFHVASQVMSYQQVKMEEPLPLPYLHQQPPRMLHSGQYFSLPAVHPGDLTPSAIRRYCKAEQVSGQTSALSASRDTGLSTDPNAAGCAEISSAPTSQPFPEFDDGILGLDDFWN

SEQ ID NO: 1279 - protein, 557 aa, Oryza sativa
MEEDGGGGAGWGWATWRVAAVAAAAAVWVTMHVAARMADALWWRPRRLEAHFAAQGVRGPPYRFLLGSVREMVALMAEASSKPMSPPTSHNALPRVLAFYHYWRKIYGHRFLIWFGPTPRLTVAEPELIREIFLTRADAFDRYEAHPVVRQLEGDGLVSLHGDKWALHRRVLTDAFYPDNLNRLIPHVGKSVAALAAKWGAMAEAGGSGEVEVDVAEWFQAVTEEAITRATFGRSYDDGRVVFAMQGQLMAFASEAFRKVLVPGYRFLPTKKNRLSWRLDREIRRSLMRLIGRRSDEAEQGEKADDGSFRDLLGLMINAGAAAATRGNAGGEKNSPAAAIPVEDMLEECKTFFFAGKQTTTNLLTWATVLLAMHPDWQERARREVFDVCGAGELPSKEHLPKLKTLGMIMNETLRLYPPAVATIRRAKVDVQLSDGCMIPRDMELLVPIMAIHHDTRYWGPDASQFNPARFANGASKAAKHPLAFIPFGLGSRMCVGQNLARLEAKLTMAILLQRFEIRTSPNYVHAPTVLMLLYPQYGAPLIFRPLSSHPPDSTGP

SEQ ID NO: 1280 - protein, 538 aa, Oryza sativa
MMEAVAVAAAVLLLLHVAARVADAVWWRPRRLEAHFAGQGVRGPPYRFLVGCVREMVALMAEATAKPMPPAAPHNALPRVLAFYHYWRKIYGPTFLIWFGPTPRLTVAEPEMVREIFLTRAEAFDRYEAHPVVRQLEGDGLVSLHGDKWAHHRRVLTPGFYPDNLNRLVPHVGRSVAALAERWRAMACAGGGEVEVDVAEWFQAVAEEAITRATFGRSYDSGRVVFRLQARLMAFASEAFRKVLVPGYRFLPTKKNRMSWGLDREIRRGLVRLIGRRSGGDGGEEDETTTELKDKQDSGFNDLLGLMINAGVDRTMPVEDMVEECKTFFFAGKQTTTNLLTWATVLLAMHPDWQDRARREVLAVCGDAAGELPTKDHLPKLKTLGMILNETLRLYPPAVATIRRAKFDVTLGGGGDGDAGGIHIPRDTELLVPIMAIHHDARLWGPDAAQFNPARFASGAARAAKHPLAFIPFGLGSRMCIGQSLAILEAKLTMAVLLQRFDLALSPTYVHAPTVLMLLHPQYGAPLIFRPRQSQPSN

SEQ ID NO: 1281 - protein, 542 aa, Oryza sativa
MGWWGWAAAAAAAAAWVAVKVLEVLWWRPRRVEEHFARQGITGPRYRFLVGCVREMVALMVAASAKPMPPPYRSHNVLPRVLAFYHHWKKIYGSTFLIWFGPTPRLAIADPELIREVLLARADRFDRYESHPMVRQLEGEGLVSLRGDKWAHHRRVLTPAFHMDNLRLLLPCVGMTVLDMADKWRAMAEADKSGEVEIDVSDWFQVVTEDAITRTAFGRSYEDGKVVFKLQAQLMAFASEAFRKVFIPGYRFLPTKKNTSSWKLDKEIRKNLVTLIGRRQEAGDDEKLDGCAKDLLGLMINAAASSNGGKRSALPVSPITVNDIVEECKTFFFAGKQTTSNLLTWAIVVLAMHPEWQERARQEVLDVCGADGVPSREQLAKLKTLGMILNETLRLYPPAVATVRRAKADVELGGYLRIPRDTELLIPIMAVHHDARLWGPDAAQFNPARFAGGVARAARHPAAFIPFGLGARMCIGQNLAILEAKLTVAVILHRFEFRLSARYVHAPTVLMLLHPQYGAPIVFRPRSSSQPTCEKMNPLTSS

SEQ ID NO: 1282 - protein, 440 aa, Oryza sativa
MGECKVGGGGGGGDCLIKLFGKTIPVPEPGACAAGDVDKDLQHSGSSTTEPKTQENTVQDSTSPPPQPEVVDTEDSSADKNSSENQQQQGDTANQKEKLKKPDKILPCPRCSSMDTKFCYYNNYNINQPRHFCKNCQRYWTAGGAMRNVPVGAGRRKSKSVSAASHFLQRVRAALPGDPPLYAPVKTNGTVLSFGSDLSTLDLTEQMKHLKDKFIPTTGIKNTDEMPVGLCAEGLSKTEESNQTNLKEKVSADRSPNVAQHPCMNGGAMWPFGVAPPPAYYTSSIAIPFYPAAAAAVAAYWGCMVPGAWNAPWPPQSQSQSVSSSSAASPVSTMTNCFRLGKHPRDGDEELDSKGNGKVWVPKTVRIDDVDEVARSSIWSLIGIKGDKVGADHGRGCKLAKVFESKDEAKASTHTAISSLPFMQGNPAALTRSVTFQEGS

SEQ ID NO: 1283 - protein, 341 aa, Oryza sativa
MEGSRGDKGKVVVVMGATATGKSKLAIDLALRFGGEVINSDKIQVHDGLDVVTNKVTDEERAGVPHHLIGGVPPDADYGVDDFRRDAARAVASVLARGRVPVIAGGSNRYLEALLDGEGGSFRERHELCFLWVDSRAPALHRYVRHRVDRMVEQGLVGEVRGLFRLDDADYSRGIRRSIGVPEMDAYLRQEATGALLTHGDKYKVALLASAVGEIKANTWSLARRQLRKIHRLRGLPGWSLRRLDVTRVLELKVEARSEAECAAAWEADVIAPAAREVGMFLHGGGNVVESGREEQPVVVEKMEVAAVGGAGAAAAAEKWCGRRLLETTAAYHGMEAAAAV

SEQ ID NO: 1284 - protein, 162 aa, Oryza sativa
MAKVHRLMNAVLRLAAAAAAATAAVVMVTSRETTSFFGIQMEAKYSYTPSFIFFVVAYAVAAAYSLLVLAVPAGSALSRLALTTDVVLGMVLAGAVASAGAISDIAKNGNSHAGWLPVCGQIHAYCNHVMAALIAGFVALAVHFVVVMYSLHIVTDVICPCH

SEQ ID NO: 1285 - protein, 619 aa, Oryza sativa
MSMYGRDPWGGPLEICHDSATDDDRSRNLDLDRGALSRTLDETQQSWLLAGPGDQGRKKKKYVDLGCLVVSRKLFVWTVGVLLAAAVFAGLVAGIAKAIPRHHRPPPPPDDFTVALRKALMFFNAQKSGKLPKNNNVHWRGNSCMKDGLSDPAVGRSLVGGYYDAGDAVKFNFPAAFSMTLLSWSVIEYSAKYEAVGELGHIRDTIKWGADYFLKTFNSTADTIDRVVMQVGSGATSPGSTQPNDHYCWMRPEDIDYPRPVVECHACSDLAAEMAASLAAASIVFKDNKAYSQKLVHGATTLFKFARQNRGRYSAGGSDAAKFYNSTSYWDEFVWGGSWMYLATGNSSYLQLATHPKLAKHAGAYWGGPDYGVFSWDNKLTGAQVLLSRLRLFLSPGYPYEEILRTFHNQTSIIMCSYLPIFKSFNRTKGGLIQLNHGRPQPLQYVVNAAFLASLYGDYLEAADTPGWYCGPHFYPIETLRNFARTQIEYILGKNPLKMSYVVGYGNRYPKRVHHRGASIPKNGVHYGCKGGWKWRETKKPNPNIIVGAMVAGPDRHDGFKDVRKNYNYTEATLAGNAGLVAALVALSGEGHGVDKNTMFSAVPPMFPSPPPPPAPWKP

SEQ ID NO: 1286 - protein, 310 aa, Oryza sativa
NSILITLNKHVSSQFSGVHHWLSSLDPYQEPILHVEYDGQPRLHDVPRHHLHGKVPRHGRRRDLHLHERHLLAEACPRPGVERDELVRRHVPQLAVLGDPPLRPELPAVLAPHPLHPPHGVVEHQHLVAGHHLVPAGEHVVGDRRLVLQRHRRVQPHGLAKGRVQVQEVPHLARVERHHAAVAGEEPPLLQLRLAGSDGRQLLQELLLDARVRGEEVEEPRQRRARGVAAGDEEVHRHVPDVHVGVGAAGDLVVAEEGGKQVGDRLLVAASAAALSGLALVIGSVFRDGRRDEALDRPPRRGVPLLVPNP

SEQ ID NO: 1287 - protein, 389 aa, Oryza sativa
MVAEHPTPPQPHQPPPMDSTAGSGIAAPAAAAVCDLRMEPKIPEPFVWPNGDARPASAAELDMPVVDVGVLRDGDAEGLRRAAAQVAAACATHGFFQVSEHGVDAALARAALDGASDFFRLPLAEKRRARRVPGTVSGYTSAHADRFASKLPWKETLSFGFHDRAAAPVVADYFSSTLGPDFAPMGRVYQKYCEEMKELSLTIMELLELSLGVERGYYREFFADSSSIMRCNYYPPCPEPERTLGTGPHCDPTALTILLQDDVGGLEVLVDGEWRPVSPVPGAMVINIGDTFMALSNGRYKSCLHRAVVNQRRERRSLAFFLCPREDRVVRPPPSAATPQHYPDFTWADLMRFTQRHYRADTRTLDAFTRWLAPPAADAAATAQVEAAS

SEQ ID NO: 1288 - protein, 136 aa, Oryza sativa
MDSSSVEKGSGSIDPDERTASGEPKACTDCHTTKTPLWRGGPSGPKSLCNACGIRYRKKRREALGLDAGEGGAERQEKKKSKRERGEEVTMELRMVGFGKEVVLKQRRRMRRRRRLGEEEKAAILLMALSSGVIYA

SEQ ID NO: 1289 - protein, 155 aa, Oryza sativa
MFLLPILVMAAKQRNKEEEERRSSSKKVDQLISKCVLLSFGERERERERERERERERERDLRMVNPGRTARALCLLCLALLLLGQDTHSRKLLLQEKHSHGVGNGTTTTQVSRLEPSRENGGSTGSNNNGQLQFDSAKWEEFHTDYIYTQDVKKP

SEQ ID NO: 1290 - protein, 119 aa, Oryza sativa
MSTTRGVSSSSAAAALALLLLFALCFFSFHFAAAARAVPRDEHQENGGVKAVAAVAADQLVLQLEGDTGNGDEVSELMGAAEEEAAACEEGKNNDECVQRRLLSDAHLDYIYTQHKNKP

SEQ ID NO: 1291 - protein, 102 aa, Oryza sativa
MRPTGRRSSPPVAAALALLLLLVLFFFSHCASAARPLPASAAAELVLQDGATGNGDEVSELMGAAEEEAAGLCEEGNEECVERRMLRDAHLDYIYTQKRNRP

SEQ ID NO: 1292 - protein, 251 aa, Oryza sativa
MKIFSWVANKISGKQEANRFPANSSAPYRANVSDCRKDEFSDWPQSLLAIGTFGNKQIEEVAQVENSSDNVQSVQDTVKFTEEEVDKIRKEFETLLAIKDQAEAQRSHDDDQVGLQKRADGEDNEKHIRQLINKRIIVSKSKNSLGKKGNTLKPRSVASLLKLFMCKGGFTSVVPEPRNTFPQSRMEKLLKAILQKKIHPQNSSTLVAKRHLDWKPDETEINECLEDALRDLDDDGAKWVKTDSEYIVLEM

SEQ ID NO: 1293 - protein, 529 aa, Oryza sativa
MRGAMKPSIVHCLKLLMLLALGGVTMHVPDEDDVVASLGALRLDGHFSFDDAHAAARDFGNRCSLLPAAVLHPGSVSDVAATVRRVFQLGRSSPLTVAARGHGHSLLGQSQAAGGIVVKMESLAAAAARAVRVHGGASPHVDAPGGELWINVLHETLKHGLAPRSWTDYLHLTVGGTLSNAGVSGQAFRHGPQVSNVNQLEIVTGRGEVVTCSHEVNSDLFYAALGGLGQFGIITRARIALEPAPKMVRWIRVLYSDFETFTEDQEKLIASEKTFDYIEGFVIINRTGILNNWRTSFKPQDPVQASQFQSDGRVLYCLELTMNFNHDEADIMEQEVGALLSRLRYISSTLFYTDVTYLEFLDRVHTSELKLRAQGLWEVPHPWLNLLIPRSTVHKFAKEVFGKILKDSNNGPILLYPVNRTKWDNRTSVVIPDEEIFYLVGFLSSAPSSSGHGSVEHAMNLNNKIVDFCEKNGVGMKQYLAPYTTQKQWKAHFGARWETFERRKHTYDPLAILAPGQRIFPKASLPMSL

SEQ ID NO: 1294 - protein, 259 aa, Oryza sativa
MTGFGSPCGACKFLRRKCVRGCVFAPYFCHEQGAAHFAAIHKVFGASNVSKLLAHLPLADRPEAAVTISYEAQARLRDPIYGCVAHIFALQQQVMTLQAQLASLKAAAAQGIHHQDVGATTKGGYMSAAATAADDQLGYGGYNQWCGSNGGGAPAASQPGAYSSNGGAGHGHDSITALLAAGSDYMQHSLYHAFEHSEGAGAVDDGHAAAAAFEAAAESSSCGMAASFAADESVWRSSSSGYQDCEDLQSVAYAYLNRS

SEQ ID NO: 1295 - protein, 948 aa, Oryza sativa
MALLLWVFSCSLFSLWILSFMRSQATEARHGTLAVMCDERARILQDQVKVSMNHLQALAILVSTFHHSKSPSAIDQTTFARYVERTAFERPLTSGLAYAARVTHSERELFERQQAWSIRAMNFSSKRPRAEEYAPVIFAQDAYKHVVSIDMLSGAEDRGNLLRARESGKVVLTAPFQLLNKRIGVVLTYAVYKSELPLNATVHDRIQSSIGYLGGVFDIEGHVDKLLEKLAGKEPMTVNIYDTTGESMIRMYGSSNESASGMCHVSTLDFGDPLRKHEMHCRFTQGPPWPWLAVASSYGTLVISLLVGYIFHFTDKWIAKVEDGYKATDMQMPAKDEFAATERISDMERDLKEDALFFDTTKSPSLLEISRLLNHRDPAQNVHQEEQELNLPLEAQDKLKETERKLGRMSKFITKVMKLTSASIRCLPSRFHCFNKKVWSISLLGFLLFILVIGAFDQPYNQPLGMGGEGDNNMMLKNFGFSRGRLLIDTLHGTWTKRGVQSSDTIRVDLRKMTRNNDSSGQQLKHWSSHKSSEIPAVLYVPMNGKQVIVHCNLIVDEKALVNWISNGDTDQSSKYQKETAGIQNRTDKPHLPANKSHKTTVSPWIVLLPVIMLVLLGSIIWRRCNDHRRRVQQKELELLGIMGPSRFQLQDLVAATGNFADENKLGQGGFGPVYKGYLRDQDLHVAIKVLSRRQSCQEQSAQGLREFKAEVKVMTQLRHRNIVKLVGWSDSKKQLLLVYELMAQGSLDKHLYDPEKILTWQQRYQIKFANLFNSTDKIVLDLGSALLYLHHDCEKCIVHGDIKPANVMLDVSHNAKLGDFGLARLVEHGGEPQTTQVVAGTPGYIDPEFINNRWPRTELDVYSFGIVLLEIACGKRPASRQLPNGASSLLAWVRDLYDQGKILDAADQRLNGEFNQQQMERVIVMGLCCSHQDPIQRPSIVQAMDVL

SEQ ID NO: 1296 - protein, 329 aa, Oryza sativa; identical to SEQ ID NO: 1091

SEQ ID NO: 1297 - protein, 323 aa, Oryza sativa
MVEAVASFRRGGVGIAGMSSSTLEEVQMQETLIFSDTIKDLKMLKSQLYSAAEYFELAYTQEDDKQEVMNNLKEYSVKALVNTVDHLGSISFKVSSLIDQRFDEVDDTNLRVSCIHQRAQVSQACMDKEGLSQQSLVITAPKYHKRYILPAGDGSMPNAVPNFSEMRKAKNRAAQMQQVFSAAAASQAKAKEKQPSFSKLRSIARAPSQRARSSSPAQRPPSENTIPTKRADKRSESPIPRTTPLTRSGSLPQKPSLLKTSSVRVQMHTSEHKKLASVRSQADRNDDKEGEQTPKKGKKFLKSLLSRRKSRKEEPLPCYFDDY

SEQ ID NO: 1298 - protein, 1127 aa, Oryza sativa
MASKGILKNGGKPPTAPSSAAPTVVFGRRTDSGRFISYSRDDLDSEISSVDFQDYHVHIPMTPDNQPMDPAAGDEQQYVSSSLFTGGFNSVTRAHVMEKQASSARATVSACMVQGCGSKIMRNGRGADILPCECDFKICVDCFTDAVKGGGGVCPGCKEPYKHAEWEEVVSASNHDAINRALSLPHGHGHGPKMERRLSLVKQNGGAPGEFDHNRWLFETKGTYGYGNAIWPEDDGVAGHPKELMSKPWRPLTRKLRIQAAVISPYRLLVLIRLVALGLFLMWRIKHQNEDAIWLWGMSIVCELWFALSWVLDQLPKLCPINRATDLSVLKDKFETPTPSNPTGKSDLPGIDIFVSTADPEKEPVLVTANTILSILAADYPVDKLACYVSDDGGALLTFEAMAEAASFANLWVPFCRKHEIEPRNPDSYFNLKRDPFKNKVKGDFVKDRRRVKREYDEFKVRVNGLPDAIRRRSDAYHAREEIQAMNLQREKMKAGGDEQQLEPIKIPKATWMADGTHWPGTWLQASPEHARGDHAGIIQVMLKPPSPSPSSSGGDMEKRVDLSGVDTRLPMLVYVSREKRPGYDHNKKAGAMNALVRASAIMSNGPFILNLDCDHYVYNSKAFREGMCFMMDRGGDRLCYVQFPQRFEGIDPSDRYANHNTVFFDVNMRALDGLQGPVYVGTGCLFRRIALYGFDPPRSKDHTTPWSCCLPRRRRTRSQPQPQEEEEETMALRMDMDGAMNMASFPKKFGNSSFLIDSIPVAEFQGRPLADHPSVKNGRPPGALTIPRETLDASIVAEAISVVSCWYEEKTEWGTRVGWIYGSVTEDVVTGYRMHNRGWKSVYCVTHRDAFRGTAPINLTDRLHQVLRWATGSVEIFFSRNNALFASSKMKVLQRIAYLNVGIYPFTSVFLIVYCFLPALSLFSGQFIVQTLNVTFLTYLLIITITLCLLAMLEIKWSGIALEEWWRNEQFWLIGGTSAHLAAVLQGLLKVIAGIEISFTLTSKQLGDDVDDEFAELYAVKWTSLMIPPLTIIMINLVAIAVGFSRTIYSTIPQWSKLLGGVFFSFWVLAHLYPFAKGLMGRRGRTPTIVYVWSGLVAITISLLWIAIKPPSAQANSQLGGSFSFP

SEQ ID NO: 1299 - protein, 1147 aa, Oryza sativa
MSTGPGKKAIRNAGGVGGGAGPSAGGPRGPAGQAVKFARRTSSGRYVSLSREDIDMEGELAADYTNYTVQIPPTPDNQPMLNGAEPASVAMKAEEQYVSNSLFTGGFNSATRAHLMDKVIESSVSHPQMAGAKGSRCAMPACDGSAMRNERGEDVDPCECHFKICRDCYLDAQKDGCICPGCKEHYKIGEYADDDPHDGKLHLPGPGGGGNKSLLARNQNGEFDHNRWLFESSGTYGYGNAFWPKGGMYDDDLDDDVDKLGGDGGGGGGGGPLPEQKPFKPLTRKIPMPTSVISPYRIFIVIRMFVLLFYLTWRIRNPNMEALWLWGMSIVCELWFAFSWLLDMLPKVNPVNRSTDLAVLKEKFETPSPSNPHGRSDLPGLDVFVSTADPEKEPVLTTATTILSILAVDYPVEKLACYVSDDGGALLTFEAMAEAASFANVWVPFCKKHDIEPRNPDSYFSVKGDPTKGKRRNDFVKDRRRVKREFDEFKVRINGLPDSIRRRSDAFNAREDMKMLKHLRETGADPSEQPKVKKATWMADGSHWPGTWAASAPDHAKGNHAGILQVMLKPPSPDPLYGMHDDDQMIDFSDVDIRLPMLVYMSREKRPGYDHNKKAGAMNALVRCSAVMSNGPFMLNFDCDHYINNAQAVREAMCFFMDRGGERIAYIQFPQRFEGIDPSDRYANNNTVFFDGNMRALDGLQGPMYVGTGCMFRRFAVYGFDPPRTAEYTGWLFTKKKVTTFKDPESDTQTLKAEDFDAELTSHLVPRRFGNSSPFMASIPVAEFQARPLADHPAVLHGRPSGALTVPRPPLDPPTVAEAVSVISCWYEDKTEWGDRVGWIYGSVTEDVVTGYRMHNRGWRSVYCITKRDAFLGTAPINLTDRLHQVLRWATGSVEIFFSRNNAFLASRKLMLLQRISYLNVGIYPFTSIFLLVYCFIPALSLFSGFFIVQKLDIAFLCYLLTMTITLVALGILEVKWSGIELEDWWRNEQFWLISGTSAHLYAVVQGLLKVMAGIEISFTLTAKAAADDNEDIYADLYIVKWSSLLIPPITIGMVNIIAIAFAFARTIYSDNPRWGKFIGGGFFSFWVLAHLNPFAKGLMGRRGKTPTIVFVWSGLLSITVSLLWVAISPPEANSNGGARGGGFQFP

SEQ ID NO: 1300 - protein, 257 aa, Oryza sativa
MAPCLLLVLFLLPALATGHQHPSTLGSSALSEWRSAKASYYAADPEDAIGGACGFGDLGKHGYGMATVGLSTALFERGAACGGCYEVKCVDDLKYCLPGTSIVVTATNFCAPNFGLPADAGGVCNPPNHHFLLPIQSFEKIALWKAGVMPIQYRRVNCLRDGGVRFAVAGRSFFLTVLISNVGGAGDVRSVKIKGTESGWLSMGRNWGQIWHINSDFRGQPLSFELTSSDGKTLTNYNVVPKEWDFGKTYTGKQFLL

SEQ ID NO: 1301 - protein, 284 aa, Oryza sativa
MASSWNNPAIFLAAALAVATAAQVVTAGFTTDLYWQQQPAPGAVTPYKTSDWHDGSATFYGDPSGMGDDFGGACGYVSNDIVSLYSTKTAALSTPLFADGNGCGQCYELRCVKSPWCNPGSPSVVITGTNLCPPNWYLPNDDGGWCNPPRHHFDMAPPSFLKLAQRVAGIVPVQYRRVPCQRTGGVRFCLQGNHYWLLLYVMNVGGAGDVSSLSVKTSGGGGAWIQAAHNWGITYQVFAALDNSDGLTVKLTTYSTPQQTIIVSDAISPWWITGLCYQGSNNFY

SEQ ID NO: 1302 - protein, 264 aa, Oryza sativa
MSPAPRVLVLVVATVVALQVSPAAGRIPGAYGGGEWQSAHATFYGGSDASGTMGGACGYGNLYSQGYGVNNAALSTALFNSGQSCGACFEIKCVNQPGWEWCHPGSPSILITATNFCPPNYALPSDNGGWCNPPRPHFDLAMPMFLHIAEYRAGIVPVSYRRVPCRKKGGVRFTINGFRYFNLVLITNVAGAGDIVRASVKGTSTGWMPMSRNWGQNWQSNSVLVGQALSFRVTGSDRRTSTSWNAAPAGWHFGQTFEGKNFRV

SEQ ID NO: 1303 - protein, 298 aa, Oryza sativa
MASNNSRTNSRANYSNEIHDLSTVQNGTMPTMYYGEKAIADFFPPHLLKKVVSEVVATFLLVFMTCGAAGISGSDLSRISQLGQSIAGGLIVTVMIYAVGHISGAHMNPAVTLAFAVFRHFPWIQVPFYWAAQFTGAICASFVLKAVIHPVDVIGTTTPVGPHWHSLVVEVIVTFNMMFVTLAVATDTRAVGELAGLAVGSAVCITSIFAGAISGGSMNPARTLGPALASNKFDGLWIYFLGPVMGTLSGAWTYTFIRFEDTPKEGSSQKLSSFKLRRLRSQQSIAADDVDEMENIQV

SEQ ID NO: 1304 - protein, 428 aa, Oryza sativa
MSSSLPILPKSLKDIPRSHNTQNILMPGQLPNDSMPLHQSATQSSISHPRASVVRSSYSAMLGYAANPIDSVSSHEGHFMAAPFISQSSNAEMLQYLCNNNTHGGHTVPTFFPAPACGAPDYMDTITVPDNHTQSGSSTVTSDAAKQNEWWADIMNDDWKDILDATATDSQSKSMAQPSNSAASQPAFNQSTSSHSGDICPVTSPPPNNSNASASKQRMRWTPELHESFVHAVNKLGGSEKATPKGVLKLMKVDGLTIYHVKSHLQKYRTARYKPDLSEGKTQEGKTTDELSLDLKASMDLTEALRLQMEVQKRLHEQLEIQRKLQLRIEEQGKYLQKMFEKQCKSSTQSVQDPSSGDTATPSEPSNSVDKDSEAALDPNRIGDNHPKNSTNVGANLKTAATESPDSPVIATDGSELPQEKRRRVHES

SEQ ID NO: 1305 - protein, 426 aa, Oryza sativa
MERISTNQLYNSGIPVTVPSPLPAIPATLDENIPRIPDGQNVPRERELRSTPMPPHQNQSTVAPLHGHFQSSTGSVGPLRSSQAIRFSSVSSNEQYTNANPYNSQPPSSGSSSTLNYGSQYGGFEPSLTDFPRDAGPTWCPDPVDGLLGYTDDVPAGNNLTENSSIAAGDELAKQSEWWNDFMNYDWKDIDNTACTETQPQVGPAAQSSVAVHQSAAQQSVSSQSGEPSAVAIPSPSGASNTSNSKTRMRWTPELHERFVDAVNLLGGSEKATPKGVLKLMKADNLTIYHVKSHLQKYRTARYRPELSEGSSEKKAASKEDIPSIDLKGGNFDLTEALRLQLELQKRLHEQLEIQRSLQLRIEEQGKCLQMMLEQQCIPGTDKAVDASTSAEGTKPSSDLPESSAVKDVPENSQNGIAKQTESGDR

SEQ ID NO: 1306 - protein, 467 aa, Oryza sativa
MSTQSVIAVKQFSGPDKIAQAYTVPQPSAHVLSNANYDYDLCGSTNSTSLSCAIQSSNIKTESISSSSLPKILPFSTDSNGESSLSRMSQAEFSDPILSSSSTFCTSLYTSSPMNSGSCRKTGYLPFLPQPPKCEQQQNSAGQSSSSLMLLDADLRNSGHADDEHTDDLKDFLNLSSDCSFHGKCSAMAYNEQMEFQFLSEQLGIAISNNEESPRLDDIYDRPPQLMSLPVSSCSDQEDLQDARSPAKVQLSSSRSSSGTASCNKPRLRWTPELHERFVDAVNKLEGPEKATPKGVLKLMKVEGLTIYHIKSHLQKYRLAKYLPETKEDKKQEEKKTKSVANGNDHAKKKSAQMAEALRMQMEVQKQLHEQLEVQRQLQLRIEEHARYLQKILEEQQKARESISSMTSTTEGESPEFAPMEKTEDKAETSSAPLSKCRITDTDAECHSKVDNKKTKPQADLEMVHDE

SEQ ID NO: 1307 - protein, 527 aa, Oryza sativa
MAGGQLNVLSTLDQAKTQWYHFMAIVIAGMGFFTDAYDLFCISLVTKLLGRIYYTDDSKDTPGALPPNVSAAVTGVALCGTLAGQLFFGWLGDKLGRKSVYGFTLILMVVCSVASGLSFGSSAKGVVSTLCFFRFWLGFGIGGDYPLSATIMSEYANKRTRGAFIAAVFAMQGFGILFGAIVALAVSAGFRHAYPAPSYSDNHAASLVPQADYVWRIILMFGTVPAALTYYWRMKMPETARYTALIARNAKQAAADMSKVLHTQIEESADRAETVAVGGESWGLFSRQFLRRHGLHLLATTSTWFLLDIAFYSQNLFQKDIFSKVGWIPPAKTMNALEELYRIARAQALIALCGTIPGYWFTVAFIEIMGRFWIQIMGFAMMTAFMLGLAIPYHHWTTPGHHTGFIVMYGFTFFFANFGPNSTTFIVPAEIYPARLRSTCHGISAAAGKAGAIIGAFGFLYAAQDQHKPEPGYPRGIGIKNALFVLAGTNFLGTIMTLLVPESKGMSLEVISQEVADGDDEEAAYPK

SEQ ID NO: 1308 - protein, 495 aa, Oryza sativa
MDMDTSHHYPWLNFSLAHHCEMEEEERGAAAELAAIAGAAPPPKLEDFLGGGCNGGSSGGACPPVQTTAPTAAELYESELKFLAAGFQLSGAAGAAPPVPALLPAAALEQTDETKQLALPPQAAVAPPPEQKKAVDSFGQRTSIYRGVTRHRWTGRYEAHLWDNSCRREGQSRKGRQVYLGGYDKEEKAARAYDLAALKYWGPSTTTNFPVAEYEKELEEMKHMTRQEFVASLRRKSSGFSRGASIYRGVTRHHQHGRWQARIGRVAGNKDLYLGTFGTEEEAAEAYDIAAIKFRGLNAVTNFEIGRYNVESIISSNLPIGSMAGNRSTKAGLELAPSSSADAIAATEANHTGVAPPSTLAFTALPMKYDQADYLSYLALQHHQQGNLQGLGFGLYSSGVNLDFANANGNGAMSNCYTNVSLHEQQQQHQHQHQQEQQQDQQDDQSQSSNNSCGSIPFATPIAFSGSYESSMTAAGTFGYYPNVAAFQTPIFGME

SEQ ID NO: 1309 - protein, 469 aa, Oryza sativa
MDMDMSSAYPHHWLSFSLSNNYHHGLLEALSTTSAPPLGEEGPAEGAPKMEDFLGGLGGGGGAVAAAPAAAPEDQLSCGELGSIAAGFLRRYPAPENAGGVTIAMATDAAAELADPARRTAETFGQRTSIYRGVTRHRWTGRYEAHLWDNSCRREGQSRKGRQVYLGGYDKEEKAARAYDLAALKYWGPTTTTNFPVANYETELEEMKSMTRQEFIASLRRKSSGFSRGASIYRGVTRHHQHGRWQARIGRVAGNKDLYLGTFSTQEEAAEAYDIAAIKFRGLNAVTNFDMSRYDVDSILNSDLPVGGGAATRASKFPSDPSLPLPSPAMPPSEKDYWSLLALHYHHHQQQQQQQQFPASAFDTYGCSSGVNVDFTMGTSSHSGSNSNSSSSSAIWGTAAGAAMGRQQNGGSSNKQSNSYSGNNIPYAAAAAMTSGSALYGGSTGSNGTWVASNTSTAPHFYNYLFGME

SEQ ID NO: 1310 - protein, 235 aa, Oryza sativa; identical to SEQ ID NO: 933

SEQ ID NO: 1311 - protein, 251 aa, Oryza sativa
MAAARMLVLLASLCALLLTASAAKWTPAFATFYGGSDASGTMGGACGYGDLYGAGYGTRTAALSTALFNGGASCGACFTIACDTRKTQWCKPGTSITVTATNFCPPNYALSGDAGGWCNPPRRHFDMSQPAWETIAVYRAGIVPVNYRRVPCQRSGGIRFAVNGHSYFELVLVTNVGGSGAVAQMWIKGSGTGWMAMSRNWGANWQSNARLDGQALSFRVQADDGRVVTAADVAPAGWSFGATYTSSAQFY

SEQ ID NO: 1312 - protein, 876 aa, Oryza sativa; identical to SEQ ID NO: 1129

SEQ ID NO: 1313 - protein, 172 aa, Oryza sativa; identical to SEQ ID NO: 1151

SEQ ID NO: 1314 - protein, 373 aa, Oryza sativa
MERCSVLGLGGGGGGGGRLDGELPPGFRFHPTDEELITYYLLRKVVDGSFNGRAIAEIDLNKCEPWELPEKAKMGEKEWYFYSLRDRKYPTGLRTNRATGAGYWKATGKDREIRSARTGALVGMKKTLVFYRGRAPKGQKTQWVMHEYRLDGTYAYHFLSSSTRDEWVIARIFTKPGVFPVVRKGRLGISGGGGDTSCFSDSTSASVGGGGGTSASSALRAPLAEASLFAAAAAPAVDGADSSNYGGGGGAGSATATANLVTGLELVPCFSTTAHMDASFGTGQYNPAPLAVEPPPPPPAFFPSLRSLQENLQLPLFLSGGMQAGVSSQPLSGGGAFHWQSGMDVKVEGAVGRAPPQMAVGPGQLDGAFAWGF

SEQ ID NO: 1315 - protein, 119 aa, Oryza sativa
MAHPHCAVKPCCCFCCCCLLVAAVLAVAVFLAMSPPAAAAAAASSSQPAAAAALQRAETTATMYTAKELREKQDVTKGAEEDVTTTTTTTGFGAESEREVPTGPDPIHHHGRGPRRQSP

SEQ ID NO: 1316 - protein, 355 aa, Oryza sativa
MDQSFGNLGGGGGAGGSGKAAASSFLQLPLSTAAAATAYYGTPLALHQAAAAAGPSQYHGHGHPHHGGGHHHSKHGGAGGGEISAAEAESIKAKIMAHPQYSALLAAYLDCQKVGAPPEVLERLTATAAKLDARPPGRHDARDPELDQFMEAYCNMLAKYREELTRPIDEAMEFLKRVESQLDTIAGGAHGGGAGSARLLLADGKSECVGSSEDDMDPSGRENEPPEIDPRAEDKELKFQLLKKYSGYLSSLRQEFSKKKKKGKLPKEARQKLLHWWELHYKWPYPSETEKIALAESTGLDQKQINNWFINQRKRHWKPSEDMPFVMMEGFHPQNAAALYMDGPFMADGMYRLGS

SEQ ID NO: 1317 - protein, 979 aa, Oryza sativa
MLEVLDMAPPRHQPAAGKAGGGRGHGHGHGHGGGGGGPAARKQPLQSSMAQPKAETAAATAAVAPPEGGKKCGGGGGRRRGGRGRGGRAGAGPGPGLAAAPAVVVAPAARAVIGPPVASKGLSFCRRPGFGTVGARCVVKANHFLAELPDKDLTQYDVKITPEVSSRSVNRAIMSELVRLYHDSDLGGRLPAYDGRKNLYTAGTLPFDAREFVVRLTDDDDGTGVPPREREYRVAIKFAARADLHHLRQFIAGRQADAPQEALQVLDIVLRELANRRYVSIGRSFYSPDIRKPQRLGDGLQSWCGFYQSIRPTQMGLSLNIDMSSTAFIEPLPVIEFVAQILGKDVISRPLSDANRIKIKKALRGVKVEVTHRGNVRRKYRISGLTTQPTHELIFPIDDQMNMKSVVEYFKEMYGFTIQHPHLPCLQVGNQKKANYLPMEACKIVEGQRYTKRLNEKQITSLLKVTCRRPREQEMDILQTVQQNGYEQDPYAKEFGINISEKLTSVEARVLPAPWLKYHDTGKEKECLPQVGQWNMVNKKVINGCKVNHWACINFSRSVQETTARGFCQELAQMCQISGMEFNSEPVIPIYSARPDQVEKALKHVYNMSLNKLKGKELELLLAILPDNNGSLYGDIKRICETDLGLISQCCLTKHVFKISKQYLANVSLKINVKMGGRNTVLLDAISWRIPLVSDIPTIIFGADVTHPETGEDSSPSIAAVVASQDWPEVTKYAGLVCAQAHRQELIQDLYKTWHDPQRGTVTGGMIRELLISFRKATGQKPLRIIFYRDGVSEGQFYQVLLYELDAIRKACASLEPNYQPPVTFVVVQKRHHTRLFANNHKDRSSTDKSGNILPGTVVDSKICHPSEFDFYLCSHAGIQGTSRPAHYHVLWDENNFTADEMQTLTNNLCYTYARCTRSVSVVPPAYYAHLAAFRARFYMEPEMSENQTTSKSSTGTNGTSVKPLPAVKEKVKRVMFYC

SEQ ID NO: 1318 - protein, 200 aa, Oryza sativa
MEALSGRVGVKCGRWNPTAEQVKVLTELFRAGLRTPSTEQIQRISTHLSAFGKVESKNVFYWFQNHKARERHHHKKRRRGASSPDSGSNDDDGRAAAHEGDADLVLQPPESKREARSYGHHHRLMTCYVRDVVETEAMWERPTREVETLELFPLKSYDLEVDKVRYVRGGGGEQCREISFFDVAAGRDPPLELRLCSFGL

SEQ ID NO: 1319 - protein, 242 aa, Oryza sativa
MAMEAAAERSAGAGAAATAAPESGGGGAGERRSRFRRICVYCGSAKGRKASYQDAAVELGKELVERGIDLVYGGGSIGLMGLVSHAVHDGGRHVIGVIPKSLMPREVTGEPVGEVRAVSGMHERKAEMARFADAFIALPGGYGTLEELLEVITWAQLGIHKKPVGLLNVDGFYDPFLSFIDMAVSEGFIAEDARRIIISAPTARELVLKLEEYVPEYEVGLVWDDQMPHSFAPDLETRITSS

SEQ ID NO: 1320 - protein, 390 aa, Oryza sativa
MSGSSADPSPSASTAGAAVSPLALLRAHGHGHGHLTATPPSGATGPAPPPPSPASGSAPRDYRKGNWTLHETLILITANRLDDDRRAGVGGAAAGGGGAGSPPTPRSAEQRWKWVENYCWKNGCLRSQNQCNDKWDNLLRDYKKVRDYESRVAAAAATGGAAAANSAPLPSYWTMERHERKDCNLPTNLAPEVYDALSEVLSRRAARRGGATIAPTPPPPPLALPLPPPPPPSPPKPLVAQQQHHHHGHHHHPPPPQPPPSSLQLPPAVVAPPPASVSAEEEMSGSSESGEEEEGSGGEPEAKRRRLSRLGSSVVRSATVVARTLVACEEKRERRHRELLQLEERRLRLEEERTEVRRQGFAGLIAAVNSLSSAIHALVSDHRSGDSSGR

SEQ ID NO: 1321 - protein, 580 aa, Oryza sativa
MSSAAGGGGGYGGGGGEHQHQQQQHHLLLGQAAGQLYHVPQHSRREKLRFPPDHPAESPPPPPPGSWPLPPAFYSYASSSSSYSPHSPTLAHAQLVAHGMPPGAATSGGAQIPSQNFALSLSSASSNPPPTPRRQFGGGGGGGGAAGPYGPFTGYAAVLGRSRFLGPAQKLLEEICDVGGRPAQLDRGSDEGLLDVDAMDAAGSVDHEMDGSDRAVADAVTVSGAEQQWRKTRLISLMEDVCKRYRQYYQQLQAVVSSFETVAGLSNAAPFASMALRTMSKHFKYLKGIILNQLRNTGKGATKDGLGKEDTTNFGLMGGGAGLLRGNNVNSFSQPHNIWRPQRGLPERAVSVLRAWLFEHFLHPYPTDSDKQMLAKQTGLTRNQVSNWFINARVRLWKPMVEEIHNLEMRQLQKNPSLDKNQLSMQHTQHSSDSSGKPCDPSNSLQGQSSSMTRNHSISASRHIEDGLSQMPHDISGQVSFAYNGLAAHHSIAMAHHHQPDLIGTGGAANAGGVSLTLGLHQNNNRAYIAEPLPAALPLNLAHRFGLEDVSDAYVMSSFGGQDRHFTKEIGGHLLHDFVG

SEQ ID NO: 1322 - protein, 460 aa, Oryza sativa
MWDLNDSPAAEAAPPPLSPSADDSGASSSSAAAVVEIPDDADDDSAAVVVVTRQFFPPAVPGGGGDPAPGNARAGWLRLAGAAPPVAATGPAASAAVSKKSRRGPRSRSSQYRGVTFYRRTGRWESHIWDCGKQVYLGGFDTAHAAARAYDRAAIKFRGVEADINFSLEDYEDDLKQMSNLTKEEFVHVLRRQSTGFPRGSSKYRGVTLHKCGRWEARMGQFLGKKYVYLGLFDTEEEAARAYDRAAIKCNGKDAVTNFDPSIYAGEFEPPAAATGDAAEHNLDLSLGSSAGSKRGNVDGGGDDEITGGGGGGAGSDQRVPMAFDLDWQTAAARSTKAKFDQNSNHPQMPPVLQVTHLPFSPRHHHQFLSNGDPGTAGGLSLTIGAGMAGHWPPQQQQGWGNAGGMSWPHPPHPPPPPTNAAAAATATAAAASSRFPPYIATQASTWLQKNGFHSLTRPT

SEQ ID NO: 1323 - protein, 462 aa, Oryza sativa
MQTRKKGATKNALGDPASTKTSRQPRRAAQAAASEKKVNDLITSSAKKKKSVGAPSKKNRASKGGRKLISACDAANSENEVSQVVSGIPHDQKQSDDNVDGRPCNSIFSPAYHLQKECGASNFAKGLEHKGDTLGSVSSVEERTTHAQGRKEVTTSRSESTSHAVKTCVGSDHHTLNAQSAFCNTPLEEDEFSELGNLSSEVSAIYLAMQQSKLECIDEHSQDSISTEGYVDPEDTEEYDDFDPYAFIKDLPDLSLVVPKFRPVLLPKQTRSCPTTTLVLDLDETLVHSTLEPCEDADFAFPVYFNFREHTIYVRCRPYLKEFLERVANLFETIIFTASQSIYAEQLLNVLDPKRKLFRHRVYRDSCVYVEGNYLKDLTVLGRDLTRIMIVDNSPQAFGFQLDNGIPIESWFDDPNDQELLKLLPFLESLVGVEDVRPYIARKFNLREKVATASSLSMDLQM

SEQ ID NO: 1324 - protein, 628 aa, Oryza sativa
MRMRWWAAPLAAVLAVILLPSSTATLSPAGINYEVVALMAIKTELQDPYNVLDNWDINSVDPCSWRMVTCSADGYVSALGLPSQSLSGKLSPGIGNLTRLQSVLLQNNAISGTIPASIGRLGMLQTLDMSDNQITGSIPSSIGDLKNLNYLKLNNNSLSGVLPDSLAAINGLALVDLSFNNLSGPLPKISSRTFNIVGNPMICGVKSGDNCSSVSMDPLSYPPDDLKTQPQQGIARSHRIAIICGVTVGSVAFATIIVSMLLWWRHRRNQQIFFDVNDQYDPEVCLGHLKRYAFKELRAATNNFNSKNILGEGGYGIVYKGFLRDGAIVAVKRLKDYNAVGGEVQFQTEVEVISLAVHRNLLRLIGFCTTENERLLVYPYMPNGSVASQLRELVNGKPALDWSRRKRIALGTARGLLYLHEQCDPKIIHRDVKASNVLLDEYFEAIVGDFGLAKLLDHRESHVTTAVRGTVGHIAPEYLSTGQSSEKTDVFGFGVLLVELITGQKALDFGRLANQKGGVLDWVKKLHQEKQLSMMVDKDLGSNYDRVELEEMVQVALLCTQYYPSHRPRMSEVIRMLEGDGLAEKWEASQNVDTPKSVSSELLPPKFMDFAADESSLGLEAMELSGPR

SEQ ID NO: 1325 - protein, 595 aa, Oryza sativa
MITAADFYHVMTAMVPLYVAMILAYGSVKWWRIFTPDQCSGINRFVALFAVPLLSFHFISTNNPYTMNLRFIAADTLQKLMVLAMLTAWSHLSRRGSLEWTITLFSLSTLPNTLVMGIPLLKGMYGEFSGSLMVQIVVLQCIIWYTLMLFMFEYRGARMLITEQFPDTAANIASIVVDPDVVSLDGRRDAIETETEVKEDGRIHVTVRRSNASRSDIYSRRSMGFSSTTPRPSNLTNAEIYSLQSSRNPTPRGSSFNHTDFYSMVGRSSNFGAADAFGVRTGATPRPSNYEDDASKPKYPLPASNAAPMAGHYPAPNPAVSSAPKGAKKAATNGQAKGEDLHMFVWSSSASPVSDVFGGGAPDYNDAAAVKSPRKMDGAKDREDYVERDDFSFGNRGVMDRDAEAGDEKAAAAAGADPSKAMAAPTAMPPTSVMTRLILIMVWRKLIRNPNTYSSLIGLIWSLVCFRWNFEMPAIVLKSISILSDAGLGMAMFSLGLFMALQPHIIACGNKVATYAMAVRFLAGPAVMAAASFAVGLRGTLLHVAIVQAALPQGIVPFVFAKEYSVHPSILSTAVIFGMLIALPITLVYYILLGL

SEQ ID NO: 1326 - protein, 630 aa, Oryza sativa
MITGRDIYDVLAAIVPLYVAMFLAYGSVRWWGIFTPDQCSGINRFVAVFAVPLLSFHFISTNDPYSMNYRFLAADSLQKLVILAALAVWHNLLSRYRRNGGAAASLDWTITLFSLSTLPNTLVMGIPLLRAMYGDFSGSLMVQIVVLQSVIWYTLMLFLFEYRGAKALISEQFPPDVGASIASFRVDSDVVSLNGREALQADAEVGRDGRVHVVIRRSASASTTGGGGGAARSGVSRAYGASNAMTPRASNLTGVEIYSLQTSREPTPRASSFNQADFYAMFSGSKMASQMASPMAQHGGAGGRAQGLDEQVTNKFASGKAADPPSYPAPNPGMMPAPRKKELGGSNSNSNKELHMFVWSSSASPVSEANLRNAVNHAASTDFASAPPPAAVPVGGATPKGVSGSVTPAAKNGGGELEIEDGLKSPAAGLAAKFPVSGSPYVAPRKKGGGADVPGLAEAAHPMPPTSVMTRLILIMVWRKLIRNPNTYSSLIGLVWSLVSFRWNIQMPSIIKGSISILSDAGLGMAMFSLGLFMALQPKIISCGKTVATFAMAVRFLTGPAVIAATSIAIGLRGVLLHVAIVQAALPQGIVPFVFAKEYNCHPQILSTAVIFGMLIALPITILYYVLLGI

SEQ ID NO: 1327 - protein, 2260 aa, Oryza sativa
MGDGGVACAVPPQRAVEGFRAGGLVRRPGGEAMPDKGERGHHTTSNNHHSHSHSHRKHHAELEEGELLNGEADNSSSRDLERSMPPKKWRKVLAASSAAEVEPGEIVMPSKKARKNGELEKGEIAPERQRKDKSDKSGRKSNKDEVEPGEVAPPDKKQDRDHNKKLGSSAQVRDDGSKKGSSRDSDEEPGEIRPESSSTGSARKSRATEPENSNHKHQADTCDQTGSKSRRKGEAKSSGRHLSGRNRDISPMTRDRHERSPGILGRFPHDRLRHDRSPSRLEPSPRDRGRHYDNRDRSPYISPRHRMRPSHYRDNTPSRGEMHHHRDNTPSRVDSSPRRSQHEDFRDRSPSRRDKSPSERGRTTESHEAGKKSRGAKLENNSLEKAQHKSKSTKQSTKSKSSSNGSNEKISKEKATETIQYTELPPPPPLPPPPPPPPPPPPPLPPNMPPPLPPPPEPELNGAPAEDVSMEEDMDICDTPPHTTSSAPGPTEPPASDVGKWFYLDHYGIEQGPSKLADLKKLVEDGYLLSDHLIKHADSNRWVTVENAASPLVPSEFPSVYSDVSTQLVSPPEAPGNLLDEAREEASGTDHEQMKEASAEEQEDFYIDDRVDALMDGSIMVDGQELEILGELLNAHFEPVNWESEDLSRFQVKLERDDGTKRSTEFPDSRTAHIYGVVPAERDTYQPHIESSEWYSGRWSCKGGDWKRNDDFSQDKPYRKKLVLNEGYPLCQMPKGNHEDPRWGCKDDLYYPLRAKKLDLPLWAFSSTEENDDTVDDASKSGVMPGRSGQTKQPPKGVKGTTLPVVKINARVVKDQSSSELRIKPKVADRPPSRSSRSHSIGTDRSSTHEGSSHSKKHHEHDSQSLHKSKSVPNIPKDHVCTVEELSVKVGDWYYLDGTGHERGPFSYSELQELAKKGTILEGSSVFRKIDNTWLPVLKDLKSGCSARNGEAGSSTSALTHSNQSNFHEMHPQFVGYTRGKLHELVMKYFKSRELTLAINEVLEPWIATKQPRKELETFFSHSSASKNFVQEDGGSTKRARLLPDQSDEYTDMSEDILASQKDDCCFEDLFEGAAHVKESPLNSRTESESWGLLNEHVLARIFHFLRADVKSLISSAATCSWWNTAAKYYRSVCRFIDLSSLGPQCTDNVFHDIMAGYDMQNIRTLVLTGCSNLSSLALAEVLKRFPHISYVHIQGCSQLGDLKNKFQHVKWIKSSLNPDASYQKIRSLKQIDDGSNSTSKAGRILTSQMGGSDELDGYFADISNRESSTLSFGQGFYKRSKWLDIRKSSAVLSRDAQMRRLMQRKAENSYRKMEEFVINKLKEIMKSSRFDFFVPKVAKIEVRLKNGYYARHGFSYIKNDIRSMCRDALRYKGRSDLGDMKQIVVAFIQLAKKLENPRLISDRDGTAVQKDSSDMSQYSSDLKLKKKQSKTMSERRGANWTTAGADPSSRAFDREIKRSLSKLKKRDIDSGSETSDDDDGYSEGDETESETTVSDTESDLDVNSGAWDLKGNGMKLFESSESLTDDRGWGARMTKASLVPPVTRKYEVIEKYLIVADEEEVLRKMRVALPDDYSEKLLSQKNGTENLELPEVKDYQPRKVPGDEVLEQEVYGIDPYTHNLLLEMMPTELDWPSSDKHTFVEELLLNTLNKQVRQFTGSGNTPMVYPLKPVIEEIQKSAEESGDRRTSKMCLGMLKAMRNHPEYNYVAYRKGLGVVCNKTGGFGVDDFVIEFFGEVYPSWRWYEKQDGIKHIQNNSDDQAPEFYNIMLERPKGDRDGYDLVFVDAMHKANYASRICHSCNPNCEAKVTAVDGHYQIGIYTVRPIAEGEEITFDYNSVTESKEEHEASVCLCGSQICRGSYLNFSGEGAFEKVLMEFHGVLDRHSLLLQACEANSVSQQDLIDLGRAGLGTCLLAGLPGWLVAYTAHLVRFIFFERQKLPHEIFKHNVDEKRQFFTDINMDSEKNDAEVQAEGVLNSRLQNLTHTLDKVRYVMRCIFGDPKNAPPPLVRLTGRSLVSAIWKGEGSLVDELLESMEPHVEEDVLTDLKAKIRAHDPSGSEDIEGEIRSSLLWLRDELRTLSCTYKCRHDAAADLIHMYAYTKCFFRVRDYKTVKSPPVLISPLDLGPKYADKLGPGFQEYCKTYPENYCLGQLIYWYSQNAEPESRLTRARKGCMSLPDVSSFYVKSVKPTQERVYGSRTVRFMLARMENQAQRPWPKDRIWVFKSDPRFFGTPMMDAVLNNSPLDKEMVHWLKTRSNVFLG

SEQ ID NO: 1328 - protein, 512 aa, Oryza sativa
MELDLNNVAEGVVEKHETAARSDSGTSESSVLNGEASGAAIAPAEEGSSSTPPSPPPPPAAVLEFSILRSSASASGENDADDDEEEEATPSPPPHHQHQQLLVTRELFPSAAPSPQHWAELGFLRPDPPRPHPDIRILAHAPPPAPPPPPPQPQPQAAKKSRRGPRSRSSQYRGVTFYRRTGRWESHIWDCGKQVYLGGFDTAHAAARAYDRAAIKFRGVEADINFNLSDYEEDMRQMKSLSKEEFVHVLRRQSTGFSRGSSKYRGVTLHKCGRWEARMGQFLGKKYIYLGLFDSEVEAARAYDKAAIKCNGREAVTNFEPSTYDGELPTDAAAQGADVDLNLRISQPAASQQSPKRDSGSLGLQIHHGSFEGSEFKRAKNDAAPSELASRPHRFPLLTEHPPIWTAQPHPLFPNNEDASRSSDQKRKPSEGVAVPSWAWKQVSHHHPAPPHTLPLPFFSSSSSSPSSSSAAASSGFSKAATTAAAAQHTATLRFDPTAPSSSSSSRHHHHH

SEQ ID NO: 1329 - protein, 714 aa, Oryza sativa
MPMPPQCASSKPPSPPPPPHPHEHEVGDDMAEEAPPPPPPPKLLYIAVSDAAARRAFRYTRPVLQGTLQLMGCKARHAFKISKRVFNVMRSEFLDASKSDTADNEENAPSLVKDVEMLKPKILEATLSSIPFELYKTQTTIVVSREKFLSVVCDALSSYKYVGPNQKADFLLACRIKERKESVTVLLCGTSGCGKSTLSSLLGSRLGITTVVSTDSIRHMMRGFTDEKQNPLLYASTYHAGECLDPVAVAQAKAKRKAQKLDIVSHPNTNEGRDDTSDDKAHHGSSELPPRTELIGSKQMAIEGFKAQSEMVIDSLDRLITSWEEQKQSVIVEGVHLSLNFVMGLMKKHPSIIPFMVYIANEEKHMERFAVRAKYMTLDPAKNRYIKYIRNIRAIQDYLCNRADKHLVPKINNTNVDQSVAAIHATVFSCLRRREAGEQLYDLNTNTVAVVNEEYRNQRAANSLGSKGMFQLIQRQGSSRNLMAILNTDGSVTKAWHVDKNNGNGSLDGTSSDKSTKNPMYDTFGKAEPVNLQFGSFGISAWMSDTGGTSHTGSVDDLRADGIETGGRYYSSCCSSPKVSDCPSKELMEDDYSVFGSEEDADDPPDAGTDEDLTDEERDMHEIEAGSVDEHSTKSDEEYDDLAMQDVMENGYWSDDEQAASSTKNSSNQEKNIHGAADGDVVDDEGSGNDRFHHNLAFFLKMSKKVAATELPCA

SEQ ID NO: 1330 - protein, 336 aa, Oryza sativa; identical to SEQ ID NO: 972

SEQ ID NO: 1331 - protein, 242 aa, Oryza sativa
MGRGKIVIRRIDNSTSRQVTFSKRRNGLLKKAKELSILCDAEVGLVVFSSTGRLYEFSSTNMKTVIDRYTNAKEELLGGNATSEIKIWQREAASLRQQLHNLQESHKQLMGEELSGLGVRDLQGLENRLEISLRNIRMRKDNLLKSEIEELHVKGSLIHQENIELSRSLNVMSQQKLELYNKLQACEQRGATDANESSSTPYSFRIIQNANMPPSLELSQSQQREGECSKTAAPELGRLHLP

SEQ ID NO: 1332 - protein, 318 aa, Oryza sativa
MLRSTHPPPSSPSSSSSGGGGGGGSSASSSSEKTMVGGGGGGGGGSGSAAPSGAKLLQILNVRVVGSGERVVVLSHGFGTDQSAWSRVLPYLTRDHRVVLYDLVCAGSVNPDHFDFRRYDNLDAYVDDLLAILDALRIPRCAFVGHSVSAMIGILASIRRPDLFAKLVLIGASPRFLNDSDYHGGFELEEIQQVFDAMGANYSAWATGYAPLAVGADVPAAVQEFSRTLFNMRPDISLHVCQTVFKTDLRGVLGMVRAPCVVVQTTRDVSVPASVAAYLKAHLGGRTTVEFLQTEGHLPHLSAPSLLAQVLRRALARY

SEQ ID NO: 1333 - protein, 609 aa, Oryza sativa
MATQAIAPMHAAVVHRHHVLPPRRCVRRRGVFVRASAAAAAAAAETDTLSAAFWDYNLLFRSQRDECLDSIPLRVTEGAIPPDFPAGTYYLAGPGIFSDDHGSTVHPLDGHGYLRSFRFRPGDRTIHYSARFVETAAKREESRDGASWRFTHRGPFSVLQGGKKVGNVKVMKNVANTSVLRWGGRLLCLWEGGQPYEVDPRTLETVGPFDLLGLAAADDNKATNASAARRPWLQEAGLDAAARLLRPVLSGVFDMPGKRLLAHYKIDPRRGRLLMVACNAEDMLLPRSHFTFYEFDAHFDLVQKREFVVPDHLMIHDWAFTDTHYILLGNRIKLDIPGSLLALTGTHPMIAALAVDPRRQSTPVYLLPRSPETEAGGRDWSVPIEAPSQMWSVHVGNAFEEANRRGGLDVRLHMSSCSYQWFHFHRMFGYNWHHKKLDPSFMNAAKGKEWLPRLVQVAIELDRTGECRRCSVRRLSDQHARPADFPAINPSYANQRNRFVYAGAASGSRRFLPYFPFDSVVKVDVSDGSARWWSTDGRKFVGEPVFVPTGGGEDGGYVLLVEYAVSKHRCHLVVLDAKKIGTENALVAKLEVPKNLTFPMGFHGFWGDE

SEQ ID NO: 1334 - protein, 278 aa, Oryza sativa
METTTLVLLLPHGGAGGVRPAAAATAKRSYVMRRCCSTVRAVMARPQEAPASAPAKKTETAAMMSTVQTETAAAPPATVYRDSWFDKLAIGYLSRNLQEASGLKNEKDGYESLIDAALAISRIFSLDKQSEIVTQALERALPSYILTMIKVMMPPSRFSREYFAAFTTIFFPWLVGPCEVMESEVEGRKEKNVVYIPKCRFLESTNCVGMCTNLCKIPCQKFIQDSLGMKVYMSPNFEDMSCEMIFGQQPPEDDPALKQPCFRTKCVAKQNHGVNCSI

SEQ ID NO: 1335 - protein, 630 aa, Oryza sativa; identical to SEQ ID NO: 1326

SEQ ID NO: 1336 - protein, 577 aa, Oryza sativa
MESFFVFFTAAALPVVVAAAVIAGLCITAAWLARPRRVAEVFRRQGIDGPPPSSFLAGNLPEMKARVAAAASAAAPTADGEETASAGGGGGGRDFEKDGFDDYCTRIFPYFHKWRKAYGETYLYWLRRRPALYVTDPELIGEIGRCVSLDMGKPKYLQKGQEPLFGGGVLKANGACWARQRKVIAPEFYMARVRAMVQLMVDAAQPLIASWESRIDAAGGAAAAEVVVDGDLRSFSFDVISRACFGSDYSRGREIFLRLRELSGLMSETSVIFSIPSLRHLPTGKNRRIWRLTGEIRSLIMELVRERRCAARAAREHGGKAAPPSPPERDFLGSIIENSGGQPRPDDFVVDNCKNIYFAGHETSAVTATWCLMLLAAHPEWQDRARAEVLEVCGGDGAAAPAAPDFDMVSRMRTVGMVVQETLRLFPPSSFVVRETFRDMQLGRLLAPKGTYLFVPVSTMHHDVAAWGPTARLFDPSRFRDGVAAACKHPQASFMPFGLGARTCLGQNLALVEVKTLVAVVLARFEFTLSPEYRHSPAFRLIIEPEFGLRLRIRRAGGQDATSQVDTSTAPVHSSHN

SEQ ID NO: 1337 - protein, 217 aa, Oryza sativa
MAAGYRAEDDYDYLFKVVLIGDSGVGKSNLLSRFTRNEFSLESKSTIGVEFATRSLQVDGKVVKAQIWDTAGQERYRAITSAYYRGAVGALLVYDVTRHSTFENVERWLKELRDHTDPNIVVMLVGNKSDLRHLVAVQTDEGKAFAERESLYFMETSALESTNVENAFAEVLTQIYRIVSKRSVEAGDDAGSGPGKGEKINIKDDVSAVKKGGCCSG

SEQ ID NO: 1338 - protein, 257 aa, Oryza sativa; identical to SEQ ID NO: 949

SEQ ID NO: 1339 - protein, 428 aa, Oryza sativa; identical to SEQ ID NO: 953

SEQ ID NO: 1340 - protein, 325 aa, Oryza sativa
MEYHVGGVIGQSPKPKVVFVLGATATGKSKLAISIAERFGGEVINSDKIQVHDGFPIITNKVTEEERAGVPHHLLGVLHPDADFTAEDFRREAAAAVARVLAAGRLPVVAGGSNTYVEALVEGGGGAFRAAHDCLFLWTDVAPGLLRWYTAARVDDMVRRGLVGEARAGFVDGAGAADYYTRGVRRAIGIPEMHGYLLAERSGGEAADDGELAAMLDGAVREIKANTYRLAATQVAKIRRLSALDGWDVRRVDATVVVARMAEGAPHRETWEAVVWKPCEEMVGRFLEASAAVDDDDNAAAGSPAALAPMTAACRLRAQLVQLQY

SEQ ID NO: 1341 - protein, 341 aa, Oryza sativa; identical to SEQ ID NO: 1283

SEQ ID NO: 1342 - protein, 235 aa, Oryza sativa
MLNFHPSCDCFLNMLGNKLVVIIGATGTGKTRLSIEIAKAIGGEVVNADKMQIYDGLDITTNKVSLQDRCGISHHLIASIPRNAGDFPVSFFRSAAKTTINCIARRGHTPIVVGGSNSLIHGLLVDNFDSSIVDPFGQLEVSYRPTPRSQCCFLWVHVNEVILNEYLKHRVDDMVDAGLVEEIEEYFDTLSVNGHVPYVGLGKTIGVPELSEYFTGRVSCSDALSMMKTNTQILA

SEQ ID NO: 1343 - protein, 378 aa, Oryza sativa
MSSLGLKIRTVVRSPMAAAAVAGVGRDGSFASQKRPRRVSVRMERSRVGDGCCCSCSGRGGVASTTAVRPSTGMVVIVGATGTGKTKLSIDAAQELAGEVVNADKIQLYDGLDVTTNKVSLADRRGVPHHLLGAIRAEAGELPPSSFRSLAAAAAAGIASRGRVPVVAGGSNSLIHALLADPIDAAPRDPFADADVGYRPALRFPCCLLWVDVDDDVLDEYLDRRVDDMVGEGMVEELEEYFATTSASERASHAGLGKAIGVPELGDYFAGRKSLDAAIDEIKANTRVLAARQVGKIRRMADVWGWPIRRLDATATIRARLSGAGRAAEAAAWERDVRGPGLAAMRQFVGRADFNAAAVDQLAARSRRQCLRGGMVAG

SEQ ID NO: 1344 - protein, 255 aa, Oryza sativa; identical to SEQ ID NO: 1124

SEQ ID NO: 1345 - skipped

SEQ ID NO: 1346 - protein, 418 aa, Oryza sativa
MEMASGGGAAAAAGGGVGGSGGGGGGGDEHRQLHGLKFGKKIYFEDAAAAAGGGGTGSGSGSASAAPPSSSSKAAGGGRGGGGKNKGKGVAAAAPPPPPPPPRCQVEGCGADLSGIKNYYCRHKVCFMHSKAPRVVVAGLEQRFCQQCSRFHLLPEFDQGKRSCRRRLAGHNERRRRPQTPLASRYGRLAASVGEEHRRFRSFTLDFSYPRVPSSVRNAWPAIQPGDRISGGIQWHRNVAPHGHSSAVAGYGANTYSGQGSSSSGPPVFAGPNLPPGGCLAGVGAATDSSCALSLLSTQPWDTTTHSAAASHNQAAAMSTTTSFDGNPVAPSAMAGSYMAPSPWTGSRGHEGGGRSVAHQLPHEVSLDEVHPGPSHHAHFSGELELALQGNGPAPAPRIDPGSGSTFDQTSNTMDWSL

SEQ ID NO: 1347 - protein, 396 aa, Oryza sativa
MDAMRQSTPRAMLLLCAVLMLAVAPPGAATAAAVAGCECGNAAAAAVAGEDARGALRLKLVAIASILAAGAAGVLVPVLGRSFAALRPDGDVFFAVKAFAAGVILATGMVHILPAAFDALASPCGGGRGGGGGFPFAGLVAMAAAMATMMIDSVAAGYYRRSHFKKPRPVDDPADAARAAGVEEGGAEHAGHVHVHTHATHGHAHGHVHSHGHGHGHSHGSAPAAATSPEDASVAETIRHRVVSQVLELGILVHSVIIGVSLGASLRPSSIRPLVGALSFHQFFEGIGLGGCIVQANFKAKATVIMATFFSLTAPVGIALGIAISSSYSKHSSTALVVEGVFNSAAAGILIYMSLVDLLAADFNNPKLQTNTKLQLAVYLALFLGAGMMSLLAIWA

SEQ ID NO: 1348 - protein, 353 aa, Oryza sativa
MATAAMTKVFVLLFLVAACYLPAHAAAAECDCATDTAGRDKAQALRLKVIAIFCILAGSTVGAALPSLGGRFPAIQPETDVFLSVKAFAGGVILATGLVHILPAAFEALSSPCLVGGPWKRFPFAGMVAMVSAIGTLIVDTVATGYFHRTDAKRKAAAVADEPADDLEASDEHSHGHAHGMSVMSVAPAGEEDLVRHRVISQVLELGVVVHSLIIGMSLGASDFPSTVRPLVPALTFHQFFEGIGLGGCIVQAKFRVRSVVTMALFFSLTTPAGIVVGIGISSVYDANSPTALVVQGLLEAAAAGILVYMALVDILAEDFMKTKVQRRGRLQLAMNVALLLGAGLMSMIAIWA

SEQ ID NO: 1349 - protein, 164 aa, Oryza sativa; identical to SEQ ID NO: 1067

SEQ ID NO: 1350 - protein, 391 aa, Oryza sativa; identical to SEQ ID NO: 1089

SEQ ID NO: 1351 - protein, 393 aa, Oryza sativa
MPSSGGAMPALPPGFRFHPTDEELIVHYLMNQAASIKCPVPIIAEVNIYKCNPWDLPGKALFGENEWYFFSPRDRKYPNGARPNRAAGSGYWKATGTDKSILSTPTSDNIGVKKALVFYKGKPPKGVKTDWIMHEYRLTGTSANNTTTTKQRRASSMTMRLDDWVLCRIHKKSNDFNSSDQHDQEPEGSTVDEQLEDIHDNNSSSQQPPAPPDMNNQQSDFQPMTAMSMSKSCSLTDLLNNLDCAALSQFLLDGSSDAIAELPAPPSPLIYPNQTLNYNINNNMPHAFESRLDHHDGYVNNYNVNGLRRKRMMACSATSFDDGSSSSSSDFLHVAKKPLLLPSDSRGSGFGGGYCNQQLSETATGFQFQNGNMLSHPFPLNQQLLLNNHLQMQ

SEQ ID NO: 1352 - protein, 266 aa, Oryza sativa
MGILVILVDLQCCRCDAKIRKVLGCLEEEYCIEKVEYDVKNNRVIVRGKFDPEKLCKKIWCKAGKIIKEILIVDVWPPPLPQPPPPCKPPPCEKPPEDCKPKPCHCCSCEKPKPKPKPCHCEKPKPCHCEKPKPCEKPPPCKPEEPPKPPPEKPPPKPECKLVPYPYPVPYPYAGQWCCPKPEPPKPPPEPPKEPEPPKPCGCSHAFVCVCKPAPPPPPPCGCSGGHGNCGCGIRPWPPQVWPPPPVCPPPPWCYTEDNANACSIM

SEQ ID NO: 1353 - protein, 1033 aa, Oryza sativa
MAPAVSASQGVIMRSLTSKLDSLLLQPPEPPPPAQPSSLRKGERKKILLLRGDLRHLLDDYYLLVEPPSDTAPPPDSTAACWAKEVRELSYDVDDFLDELTTQLLHHRGGGDGSSTAGAKKMISSMIARLRGELNRRRWIADEVTLFSARVKEAIRRQESYHLGRRTSSSRPREEVDDDDREDSAGNERRRFLSLTFGMDDAAVHGQLVGRDISMQKLVRWLADGEPKLKVASIVGSGGVGKTTLATEFYRLHGRRLDAPFDCRAFVRTPRKPDMTKILTDMLSQLRPQHQHQSSDVWEVDRLLETIRTHLQDKRYFIIIEDLWASSMWDIVSRGLPDNNSCSRILITTEIEPVALACCGYNSEHIIKIDPLGDDVSSQLFFSGVVGQGNEFPGHLTEVSHDMIKKCGGLPLAITITARHFKSQLLDGMQQWNHIQKSLTTSNLKKNPTLQGMRQVLNLIYNNLPHCLKACLLYLSIYKEDYIIRKANLVRQWMAEGFINSIENKVMEEVAGNYFDELVGRGLVQPVDVNCKNEVLSCVVHHMVLNFIRCKSIEENFSITLDHSQTTVRHADKVRRLSLHFSNAHDTTPLAGLRLSQVRSMAFFGQVKCMPSIADYRLLRVLILCFWADQEKTSYDLTSISELLQLRYLKITGNITVKLPEKIQGLQHLQTLEADARATAVLLDIVHTQCLLHLRLVLLDLLPHCHRYIFTSIPKWTGKLNNLRILNIAVMQISQDDLDTLKGLGSLTALSLLVRTAPAQRIVAANEGFGSLKYFMFVCTAPCMTFVEGAMPSVQRLNLRFNANEFKQYDSKETGLEHLVALAEISARIGGTDDDESNKTEVESALRTAIRKHPTPSTLMVDIQWVDWIFGAEGRDLDEDLAQQDDHGFCMLPESSSRLQSREISIEEDMPTGAEGTVIVPHTMEQFALHMSQAKQSHKLVVIQFTTSRCPASRYIAPAFTEYAKEFAGAVFIKVNVDSDELESVTDWYDIEGIVPTFFFVKDGEKIDKIPGANKELLRAKIRRHTASPYFLR

SEQ ID NO: 1354 - protein, 953 aa, Oryza sativa
MQAFLRAAEVMKKKDELLKLVKLRERHRIAIRIHNLKSRVEEVSSRNTRYNLVEPISSGTEDDMDSYAEDIRNQSARNVDEAELVGFSDSKKRLLEMIDTNANDGPAKVICVVGMGGLGKTALSRKIFESEEDIRKNFPCNAWITVSQSFHRIELLKDMIRQLLGPSSLDQLLQELQGKVVVQVHHLSEYLIEELKEKRYFVVLDDLWILHDWNWINEIAFPKNNKKGSRIVITTRNVDLAEKCATASLVYHLDFLQMNDAITLLLRKTNKNHEDMESNKNMQKMVERIVNKCGRLPLAILTIGAVLATKQVSEWEKFYEHLPSELEINPSLEALRRMVTLGYNHLPSHLKPCFLYLSIFPEDFEIKRNRLVGRWIAEGFVRPKVGMTTKDVGESYFNELINRSMIQRSRVGIAGKIKTCRIHDIIRDITVSISRQENFVLLPMGDGSDLVQENTRHIAFHGSMSCKTGLDWSIIRSLAIFGDRPKSLAHAVCPDQLRMLRVLDLEDVTFLITQKDFDHIALLCHLKYLSIGYSSSIYSLPRSIGKLQGLQTLNMPSTYIAALPSEISKLQCLHTLRCIGQFHYDNFSLNHPMKCITNTICLPKVFTPLVSRDDRAKQIAELHMATKSCWSESFGVKVPKGIGKLRDLQVLEYVDIRRTSSRAIKELGQLSKLRKLGVTTNGSTKEKCKILYAAIEKLSSLQSLHVDAVLFSGIIGTLECLDSISSPPPLLRTLRLNGSLEEMPNWIEQLTHLKKFDLRRSKLKEGKTMLILGALPNLMVLYLYRNAYLGEKLVFKTGAFPNLRTLCIYELDQLREIRFEDGSSPLLEKIEIGKCRLESGIIGIIHLPKLKEIPITYGSKVAGLGQLEGEVNTHPNRPVLLMYSDRRYHDLGAEAEGSSIEVQTADPVPDAEGSVTVAVEATDPLPEQEGESSQSQVITLTTNDRSVTPYMAA

SEQ ID NO: 1355 - protein, 226 aa, Oryza sativa
MAIVYAVVARGTVVLAEFSAVSGNAGAVARRILEKLPPDAESRLCFAQDRYIFHVLRSPPPAAADGLTFLCMANDTFGRRIPFLYLEDIQMRFIKNYGRIAHNALAYAMNDEFSRVLHQQMEYFSSNPSADTLNRLRGEVSEIHTVMVDNIEKILDRGERISLLVDKTSTMQDSAFHFRKQSRRLRRALWMKNAKLLAVLTAVIVLLLYLIIAAFCGGLSLPSCRS

SEQ ID NO: 1356 - protein, 327 aa, Oryza sativa
MDAAWRGGVGCSPVCLDLCVGLSPVREPSAARHELLDRPAGCRGGGDSKSMTNDEAKIVEAKVTQMSEENRRLTEVIARLYGGQIPRLGLDGSASPPRPVSPLSGKKRSRESMETANSCDANSNRHQGGDADHAESFAADDGTCRRIKVSRVCRRIDPSDTSLVVKDGYQWRKYGQKVTRDNPSPRAYFRCAFAPSCPVKKKVQRSAEDSSLLVATYEGEHNHPHPSPRAGELPAAAGGAGGSLPCSISINSSGPTITLDLTKNGGAVQVVEAAHPPPPPDLKEVCREVASPEFRTALVEQMASALTSDPKFTGALAAAILQKLPEF

SEQ ID NO: 1357 - protein, 148 aa, Oryza sativa
MDRHIPSNLDREPNTQMEGVFHGATQIALPILNFLELIRDQRLSLLKIKIKSRHTKQESLSLVNLEKVSDTEDARMAKLQEKEKLETLMLRWNMDAGNASRIDHEVLETLQPNQCLKTLEIVAYEGHAFPSWITSTEPYLTSLVEIRL

SEQ ID NO: 1358 - protein, 998 aa, Oryza sativa
MISLPLLLFVLFFSALLLFPSSSDDDGGGDAAGDELALLSFKSSLLYQGGQSLASWNTSGHGQHCTWVGVVCGRRHPHRVVKLRLRSSNLAGIISPSLGNLSFLRTLQLSDNHLSGKIPQELSRLIRLQQLVLNFNSLSGEIPAALGNLTSLSVLELTNNTLSGAIPSSLGKLTGLTDLALAENTLSGSIPSSFGQLRRLSFLSLAFNNLSGAIPDPIWNISSLTIFEVISNKLSGTLPTNAFSNLPSLQEVYMYYNQFHGRIPASIGNASNISIFTIGLNSFSGVVPPEIGRMRNLQRLELPETLLEAKETNDWKFMTALTNCSNLQEVELGGCKFGGVLPDSVSNLSSSLVSLSIRDNKISGSLPRDIGNLVNLQYLSLANNSLTGSLPSSFSKLKNLRRLTVDNNKLIGSLPFTIGNLTQLTNMEVQFNAFGGTIPSTLGNLTKLFQINLGHNNFIGQIPIEIFSIPALSEILDVSHHNLEGSIPKEIGKLKNIVEFHADSNKLSGEIPSTIGECQLLQHLFLQNNFLNGSIPIALTQLKGLDTLDLSGNNLSGQIPMSLGDMPLLHSLNLSFNSFHGEVPTNGVFANASEIYIQGNAHICGGIPELHLPTCSLKSRKKKKHQILLLVVVICLVSTLAVFSLLYMLLTCHKRRKKEVPATTSMQGHPMITYKQLVKATDGFSSSHLLGSGSFGSVYKGEFDSQDGEITSLVAVKVLKLETPKALKSFTSECETLRNTRHRNLVKIVTICSSIDNRGNDFKAIVYDFMPNGSLEDWLHPETNDQAEQRHLTLHQRVTILLDVACALDHLHFHGPEPIVHCDIKSSNVLLDADMVAHVGDFGLARILIEGSSLMQQSTSSMGIRGTIGYAAPEYGVGNTASTHGDIYSYGILVLETVTGMRPADSTFRTGLSLRQYVEPGLHGRLMDVVDRKLGLDSEKWLQARDVSPCSSITECLVSLLRLGLSCSQELPSSRTQAGDVINELRAIKESLSMSSDM

SEQ ID NO: 1359 - protein, 106 aa, Oryza sativa
MATFELYRRSTIGMCLTETLDEMVSSGTLSPELAIQVLVQFDKSMTEALENQVKSKVSIKGHLHTYRFCDNVWTFILTEASFKNEETTEQVGKVKIVACDSKLLSQ

SEQ ID NO: 1360 - protein, 326 aa, Oryza sativa
MTSSMSPAPAPAYAQVMEDMEKGKELAAQLQGLLRDSPEAGRFVDQILHTFSRAMRALDKAAVSAAGGEGSEVQSEVTCGGGASAGGKRKAPAADRKANCRRRTQQSSGNSVVVKNLDDGQAWRKYGQKEIQNSKHPKAYFRCTHKYDQLCTAQRQVQRCDDDPASYRVTYIGEHTCRDPATAPIIAAHVIHQVAAGDNDDGCGGLQAGSRLISFVAAPAAPVDAAAAPTTSTITTVTAPGPLLQPLKVEGGVGSSDQEEVLSSLTPGSSAARGGGGGGGVAGPFGPDQGDVTSSLHWSYDAVAGMEFFKNDEVVFDLDDIMGLSF

SEQ ID NO: 1361 - protein, 440 aa, Oryza sativa
MPVNMISKLLEKAVLPALDVAPPVKIGGPRRTSVLRNPNMEKLQKGYLFPEISIKREEHLKKYPDAKVISLGIGDTTEPIPSIVTSAMAEYALALSTPEGYQGYGPEQGHKNLRKEIADKVYPDMGIKESEVFISDGAQCDIARLQTLFGPNVTIAVQDPTFPGYVDNGVIMGQTGKADDGGRYAGIEYMRCAPENAFFPDLSRVRRTDVIFFCSPNNPTGHAASREQLRQLVELARRNGSIIVFDSAYSSYISSSSSSSTPRSIYEIPGAREVAIEVSSFSKFAGFTGVRLGWAVVPDELLYSDGVPVARDFDRVVCTCFNGASGIAQAGGVACLSTEEGRGAVARVVGVYRENARVLVETFRSLGKEVHGGGDAPYVWVRFPGRRSWDVFAEILEKTHVITVPGSGFGPGGEGFIRVSAFNSRDKVLEACQRLKSFLA

SEQ ID NO: 1362 - protein, 356 aa, Oryza sativa
MASLTAALATPAAAALLLLVLLAAPASAANFTCAVASGTTCKSAILYTSPNATTYGNLVARFNTTTLPDLLGANGLPDGTLSSAPVAANSTVKIPFRCRCNGDVGQSDRLPIYVVQPQDGLDAIARNVFNAFVTYQEIAAANNIPDPNKINVSQTLWIPLPCSCDKEEGSNVMHLAYSVGKGENTSAIAAKYGVTESTLLTRNKIDDPTKLQMGQILDVPLPVCRSSISDTSADHNLMLLPDGTYGFTAGNCIRCSCSSTTYQLNCTAVQNKGCPSVPLCNGTLKLGETNGTGCGSTTCAYSGYSNSSSLIIQTSLATNQTTACQRGGSGRSQFARSMWSMSVISFHMVLIIICFL

SEQ ID NO: 1363 - protein, 491 aa, Oryza sativa
MGCFPCFGSGGKGEAKKGGGGRKDGGSADRRVARVGSDKSKSQGGLDSRKDAFIPRDANGQPIAAHTFTFRELAAATKNFRQDCLLGEGGFGRVYKGHLENGQAVAVKQLDRNGLQGNREFLVEVLMLSLLHHDNLVNLIGYCADGDQRLLVYEFMPLGSLEDHLHDIPPDKEPLDWNTRMKIAAGAAKGLEFLHDKANPPVIYRDFKSSNILLGEGYHPKLSDFGLAKLGPVGDKTHVSTRVMGTYGYCAPEYAMTGQLTVKSDVYSFGVVFLELITGRKAIDNTKPLGEQNLVAWARPLFKDRRKFPKMADPLLAGRFPMRGLYQALAVAAMCLQEQAATRPFIGDVVTALSYLASQTYDPNTPVQHSRSNASTPRARNRVGANFDQRRLHSPNHQQSPDLRKEGTTTSKYEAEVSRTNSGSGSGRRAGLDSMDVTGSQMGSPAHAGRKRESSRSTDRQRAVAEAKTWGENSRERKWPNARGSFDSTNE

SEQ ID NO: 1364 - protein, 158 aa, Oryza sativa
MAPACVSDEHAVAVSAERLWKAFMDASTLPKACAGLVDDIAVEGNGGPGTIYTMKLNPAAGVGSTYKTRVAVCDAASHVLKSDVLEAESKVGKLKSHSTETKLEATGDGSCVAKLKVEYELEDGSSLSPEKEKDIVDGYYGMLKMIEDYLVAHPAEYA

SEQ ID NO: 1365 - protein, 405 aa, Oryza sativa
MAEALVAVLRLAASAAATARPQSRSGRHGSCAARVPCPGPSPFRRGRLCARAAVAGPPEVDDDDAMTIDNLRRFFDVNVGKWNGAFYQFDAHGRVLQGISTRLSVSTYGEDDLISLLQSLYIKQASSQISFVDEEDSEEWVEYKIKETNMFTVDKYQQVGFFQEEKAFALRYQTAGMLETVLRAGVLGEDDTGEESPKNLKIPSRKPSIVCENCLYSREGNGRVRAFHIMDPKGVLDMLIIFHEKQGSEVPLMYSSDDADITNSDRIAPLLGRWEGRSVTKRSGVYGATLSEADTVVLLEKDRNGQLILDNMSTKSGSSTTTTVHWTGSANNNLLQFDGGYEMTLLPGGMYMGYPTDIGKIVNDMDSFHLEFCWMESPGKRQRLVRTYDSAGLAVSSTYFFETKV

SEQ ID NO: 1366 - protein, 572 aa, Oryza sativa
MTAAPGSLPLVNSRPVSLSLAASRSSFSSLLSGGAGSSLNLMTPPSSLPPSSPSSYFGGVSSSGFLDSPILLTPSLFPSPTTTGALFSWITTATATAAIAPESQVQGGVKDEQQQYSDFTFLPTASTAPATTMAGATATTSNSFMQDSMLMAPLGGDPYNGEQQQPWSYQEPTMDADTRPAEFTSSAAAGDVAGNGSYSQVAAPAAAGGFRQQSRRSSDDGYNWRKYGQKQMKGSENPRSYYKCTFPGCPTKKKVEQSPDGQVTEIVYKGAHSHPKPPQNGRGRGGSGYALHGGAASDAYSSADALSGTPVATPENSSASFGDDEAVNGVSSSLRVASSVGGGEDLDDDEPDSKRWRRDGGDGEGVSLVAGNRTVREPRVVVQTMSDIDILDDGYRWRKYGQKVVKGNPNPRSYYKCTTAGCPVRKHVERASNDLRAVITTYEGKHNHDVPAARGSAAAALYRATPPPQASNAGMMPTTAQPSSYLQGGGGVLPAGGYGASYGGAPTTTQPANGGGFAALSGRFDDDATGASYSYTSQQQQQPNDAVYYASRAKDEPRDDGIMSFFEQPLLF

SEQ ID NO: 1367 - protein, 489 aa, Oryza sativa
MVRLPYVTALTTLFSYGLLFAFGQLRDFFRRILDAGKSSNLKGYAPICLGLEDFYTRRLYLRIQDCFGRPIASAPDAWFDVVERYSNDSNKTLHRTTKTSKCLNLGSYNYLGFAAADEYCTPRVIESLKKYSASTCSVRVDGGNTKLHVELEELVARFVGKPAAILFGMGYVTNSAIIPALVGKGGLIISDSLNHNSIVNGARGSGATVRVFQHNNPAHLEEVLREQIAGGQPRTHRPWKKIIVIVEGIYSMEGELCKLPEVIAVCKKYKAYTYLDEAHSIGAVGKTGRGVCELLGVDPADVDIMMGTFTKSFGSCGGYIAASKEIIDHLKHICPAHIYATSMSPPAVQQVISAIKVILGEDGSNRGAKKLAQIRENSNFFRSELQKMGFEVLGDNDSPVMPIMLYNPAKIPAFSRECLRQHVAVVTVAFPATPLLLARARICISASHSREDLIKGLEVISKVGDLVGIKYFPVEHEKTASVEKLKKLQ

SEQ ID NO: 1368 - protein, 214 aa, Oryza sativa
MSSAAAATRFIKCVTVGDGAVGKTCMLICYTCNKFPTDYIPTVFDNFSANVSVDGSVVNLGLWDTAGQEDYSRLRPLSYRGADVFILSFSLISRASYENVQKKWMPELRRFAPGVPVVLVGTKLDLREDRAYLADHPASSIITTEQGEELRKLIGAVAYIECSSKTQRNIKAVFDTAIKVVLQPPRHKDVTRKKLQSSSNRPVRRYFCGSACFA

SEQ ID NO: 1369 - protein, 1410 aa, Oryza sativa
MGGPLTAAGGRGDGGAKAVEPLRPPPPPDPKTMARWYQLEALERAVRGNTLAFLETGSGKTLIAVMLLRAYAHRVRRPDSRRFAVFLVPTVVLVGQQARVVEQHTDLVVKQFCGEMGVDFWDAATWRSQLEDGEVLVMTPQILLDNLRHSFFRLQDIALLIFDECHHARGNTPYACIFKEFYHPQLNSSASDPLPRIFGMSASLIYSKDLNPHNYSKQISEIENLMNSKVYTVDSESALSEYIPFASTKIVDFDDSNISSELHANILSCLNRLNKKHIEALDRKLHGSSLENAKQRISKLHHTFVYCLYNLGVWLAAKAAEVQSYEENSLSFWGETLDKNVEGFIRNYSEEVHRELSCFLKNGHIGEKFPADSQDGILTPKVHCLIRTLLQYRHMQDLRCIVFVERVITSIVLEHLLSSIHQMSGWNVKHMAGSRPGLLSQSRKNHTEIVESFRKGKVHIIIATQILEEGLDVPSCNLVIRFDPSATVCSFIQSRGRARMENSDYLLLVGRGDVEAQTNAEKFLASGQIMREESLRLGSISCQPLENTLCEDTYYRVESTRAIVTLNSSVPLIHFFCSKLPSDEYFNPLPRFDIDKASGTCTLHLPKSSPVQTVNVEGEGSILKETVCLKACQELHAIGALTDSLLPELDVPCDEEPDIVVENKIEQPSYFPEEFVDNWRSFSRLGIYYCYKISLEGCPKTASPTDILLALKCDLGSDFTSSSFKLPGGQDNASVTMKYVGIIHLNQEQVIIARRFQTTILSFLIGDDHLEVSNGIKYFHEMQVPIGVVYLLLPLVSGRIDWCSMKFSSSPIYEANNKHMTHCHSCKDIDLLQTKDGPFCRCILKNSIVCTPHNNIFYVISGFLDLDANSCLPQHDGTVVTYKDYFKTRHGLTLTFENQPLLAGSKHVKVRNFLHNCYSKKEKEPGDRYSVELPPELCRIIMSPVSANNLHIFSYVPSIMFRIQCMLLSVKLKVQLGPTVQQFDVPVLKILEALTTKKCQEEFSQESLETLGDSFLKYVTTRHLFSEYRLQHEGILTKMKKNLISNAALCQLACSSNLVGYIHAEEFNPRDWIIPCLDYDERDNKKISFLAPNGMYSQRKMSIKSKRIADSVEALIGAYLSTAGEKAAFLLMKSLGMNIEFHTEIPVERKISMKAEEFINVRSLEGMLGYKFNDSLLLLEALTHGSYQTSGPTSCYQRLEFLGDAILDHLFTEYYYSKYPDCTPELLTDLRSASVNNNCYAHAAVKSGLNKHILHSSSELHRKMSYYLEEFGQSFTGPSYGWEAGIGLPKVLGDVIESIAGAIYLDSKCDKEVVWRSMKRLLEPLATPETIEPDPVKGLQEFCDRRSFKITYEKNHVDGVSSVIARVKAGETTYSATKSGPCKLVAKKLASKAVLKDLIAGHKDTEAAAV

SEQ ID NO: 1370 - protein, 1377 aa, Oryza sativa
MGGPLTAAGGRGDGGAKAVEPLRPPPPPDPKTMARWYQLEALERAVRGNTLAFLETGSGKTLIAVMLLRAYAHRVRRPDSRRFAVFLVPTVVLVGQQARVVEQHTDLVVKQFCGEMGVDFWDAATWRSQLEDGEVLVMTPQILLDNLRHSFFRLQDIALLIFDECHHARGNTPYACIFKEFYHPQLNSSASDPLPRIFGMSASLIYSKDLNQHNYSKQISEIENLMNSKVYTVDSESALSEYIPFASTKIVHFDDSNISSELHANILSCLNRLTKKHIEALDRKLHGSSLENAKQRISKLHRTFVYCLYNLGVWLAAKAAEVQSYEENSLSFWGETLDKNVEGFIRNYSEEVHRELSCFLKNGHIGEKFPADSQDGILTPKVHCLIRTLLQYRHMQDLRCIVFVQRVITSIVLEPLLSSIHQMSGWNVKHMAGSRPGLLSQSRKNHTEIVESFRKGKVHIIIATQILEEGLDVPSCNLVIRFDPSATVCSFIQSRGRARMENSDYLLLVGRGDVEAHTNAKKFLASGQIMREESLRLGSISCQPLENTLCEDTYYRVESTPAFDIDKASGTCTLHLPKSSPVQTVNVEGEGSILKETVCLKACQELHAIGALTDSLLPELDVPCDEEPDIVVENKIEQPSYFPEEFVDNWRSFSRLGIYYCYKISLEGCPKTASPTDILLALKCDLGSDFTSSSFKLPGGQDNASVTMKYVGIIHLNQEQVIIARRFQTTILSFLIGDDHLEVSNGIKYFHEMQVPIGVVYLLLPLVSGRIDWCSMKFSSSPIYEANNKHMTHCHSCRDIDLLQTKDGPFCRCILKNSIVCTPHNNIFYVISGFLDLDANSRLPQHDGTVVTYKDYFKTRHGLTLTFENQPLLAGSKHVKVRNFLHNYYYKKEKEPGDRYSVELPPELCRIIMSPVSANNLHIFSYVPSIMFRIQCMLLSVKLKVQLGPTVQQFDVPVLKILEALTTKKCQEEFSQESLETLGDSFLKYVTTRHLFSEYRLQHEGILTKMKKNLISNAALCQLACSSNLVGYIHAEEFNPRDWIIPCLDYDERGNKKISFLAPNGMYSQRKMSIKSKRIADSVEALIGAYLSTAGEKAAFLLMKSLGMNIEFHTEIPVERKISMKAEEFIDVRSLEGMLGYKFNDSLLLLEALTHGSYQTSGPTSCYQRLEFLGDAILDHLFTEYYYSKYPDCTPELLTDLRSASVNNNCYAHAAVKSGLNKHILHSSSELHRKMSYYLGQSFTGPSYGWEAGIGLPKVLGDVIESIAGAIYLDSKCDKEVVWRSMKRLLEPLATPETIEPDPVKGLQEFCDRRSFKITYEKNHVDGVSSVIARVKAGETTYSATKSGPCKLAKKLASKAVLKDLIAGHKDTEAAAV

SEQ ID NO: 1371 - protein, 516 aa, Oryza sativa
MDAAAASSSSSSSATMAAAAASAAEASLSGSPASSRNARHRQRKGVRLRMLRRRGRQPVEAERAPGDGGGGAVQEDLALPLGMSFAAVLAQVINTKNISGQRLHPDFLSKICTSAVKESLTNIYGDSSNSFIKNFEKSFSSTFRTLHLVNEIPVNERSHIPECSFKHDDSVAVDSLSSSDLQNQTNRIEHDLVNTVESQLVLFASDNQQLTHLRHSRSSPEADNRILNAIDRSNELKEFEIGLTMRKLQLKQSQLALSSHSHMLEKIKLSFGFQKASFKGEKFKTRMQETRDAEILRTLIDFLVSAVIVMSACFGYGTYIYSYQRITDVTSACSATSKGSKSWWMPNSVSNFSSGFLFLRCHVIAVTRMCFGILMILAIAWLAFQRSSTTGSNMPITFNLILLGIICGFAGRFCTNTLGGDGNTWLMYWEVLCSIHLLGNLFPSLLYHVLHGPISVSHREQVVWLPYWVRRCLFYAAVGLILPALTGLLPFASLSDWKDHFVEEIKSIVIGDKIEA

SEQ ID NO: 1372 - protein, 326 aa, Oryza sativa
MITMDLMGGYGRVDEQVAIQEAAAAGLRGMEHLILQLSQTGTSERSPAPAQEQQQQVDCREITDMTVSKFKKVISMLNRTGHARFRRGPVVAQSSGPAASEPAPVRSSPSAVSRPMTLDFTKAASGYGKDAGFSVSGISAASSSFLSSVTGDGSVSNGRGGGSSSLMLPPPPATSCGKPPLSSAAAAMSAGAGHKRKCHDHAHSENVAGGKYGSTGGRCHCSKRRKHRVKRTIRVPAISSKVADIPADDFSWRKYGQKPIKGSPFPRGYYKCSTLRGCPARKHVERDPTDPSMLIVTYEGEHRHSPSAAGQDHPPAPPPPLALPLA

SEQ ID NO: 1373 - protein, 1017 aa, Oryza sativa
MKNLFKSKIKWQHRSNDPASSQGQGQGLPQQTPPSPSPASSPSGGPPALSVSTVSSSSPSAAATPTGAAAAGAGGGGGGTGGEDYMLSEEEFQMQLAMALSASNSECVGDLDGEQIRKAKLISLGRGDRFAAVRDDEQTADALSRRYRDYNFLDYHEKVIDGFYDIFGPSMESSKQGKMPSLADLQTGIGDLGFEVIVINRAIDTTLQEMEQVAQCILLDFPVANIAALVQRIAELVTDHMGGPVKDANDMLTRWLEKSTELRTSLHTSLLPIGCIKIGLSRHRALLFKILADSVGIPCKLVKGSNYTGDDDDAINIIKMNEREFLVDLMAAPGTLIPSDVLSWKGNSLNSNARLTQNPLAGSSSTTDSNLSANALPPGHKGGQLPLFSSGDWISASQSGYEKDGATTSSQASSSGTTSVAAGSAFDSSWTLVSHGQSDDPSTSAGMSAQQKVILPGGEHPWNENINARNENIKLVSDLQGNSESINLFADLNPFGGREPKRTSVPLNGPDNRNNELQRRRENVVPSTRRPQQRLVMKNWSPYNDVSNNKQYNYVEDSFARRNIGDNAASSSQVPRPSAKNTNLNVVVRTDTPYMAAHNYDNSMAGSSAMKMTSTAGIGKVPDKVLYGDLDKGLTNSRLGDQPPIERHKWGNSVEGRIPTGTVHNQAKEHKENFDGKQDNKKLHPDPKKSPLDRFMDTSMPSRNPESVSPSFARSHKLDTMFDDVSECEIHWEDLVIGERIGLGSYGEVYRADWNGTEVAVKKFLDQDFYGDALDEFRSEVRIMRRLRHPNIVLFMGAVTRPPNLSIVSEYLPRGSLYKILHRPNCQIDEKRRIKMALDVAKGMNCLHISVPTIVHRDLKSPNLLVDNNWNVKVCDFGLSRLKHSTFLSSKSTAGTPEWMAPEVLRNEQSNEKCDVYSFGVILWELATLRMPWSGMNPMQVVGAVGFQDKRLDIPKEIDPLVARIIWECWQKDPNLRPSFAQLTSALKTVQRLVTPSHQESQSPPVPQEIWVNSSTP

SEQ ID NO: 1374 - protein, 483 aa, Oryza sativa
MAYQGIDLLSTKAAGDDHGENSSYFDGWKAYDTNPFDLRHNRGGVIQMGLAENQLSLDLIEEWSKNHPEASICTPEGVSQFKRIANFQDYHGLPEFRKAMAQFMGQVRGGKATFDPDRVVMSGGATGAQETLAFCLANPGEAFLVPTPYYPAFDRDCCWRSGIKLLPIECHSFNDFRLTKEALVSAYDGARRQGISVKGILITNPSNPLGTITDRDTLAMLATFATEHRVHLVCDEIYAGSVFATPEYVSIAEVIERDVPWCNRDLIHVVYSLSKDFGLPGFRVGIIYSYNDAVVAAARRMSSFGLVSSQTQYFLARMLSDEEFIGRFLQESKCRLVARHERFTSGLREVGIGCLRGNAGLFSWMDLRRMLREKTAEAELELWRVIVHQVKLNVSPGTSFHCREPGWFRVCHANMDDETMEVALGRIHDFVRQHQQRRVKAERWAANRQLRLSLPHHHHLSPAHLSSPLALLSPQSPMVRATS

SEQ ID NO: 1375 - protein, 512 aa, Oryza sativa
MATAAACISFASPSPARVVIRRQTRASASASATDRQEVVSPKRRLPLRKVPGDYGPPVVGAIRDRYEYFYGPGGRDGFFAARVRAHRSTVVRLNMPPGPFVARDPRVVALLDAASFPVLFDTSLVDKTDLFTGTFMPSTDLTGGYRVLSYLDPSEPNHAPLKTLLFYLLSHRRQQVIPKFREVYGDLFGLMENDLARVGKADFGVHNDAAAFGFLCQGLLGRDPAKSALGRDGPKLITKWVLFQLSPLLSLGLPTLVEDTLLHSLRLPPALVKKDYDRLADFFRDAAKAVVDEGERLGIAREEAVHNILFALCFNSFGGMKILFPTLVKWLGRAGARVHGRLATEVRGAVRDNGGEVTMKALAEMPLVKSAVYEALRIEPPVAMQYGRAKRDMVVESHDYGYEVREGEMLFGYQPMATKDPRVFARPEEYVPDRFLGEDGARLLRHVVWSNGPETAAPTLHDKQCAGKDFVVLVARLLLVELFLRYDSFDVEVGTSTLGSSVTVTSLKKATF

SEQ ID NO: 1376 - protein, 642 aa, Oryza sativa
MATYYSSPGNERDSQAMYPADSGNSSYPVPSAIGNMLYPGNGSSGPYTEFSGIIQHQQNFMELPGHPTAISQDSSSREPNMVASYMDQRSFGPAKDMRNEMLMHLMDGAHNAGADLIHNDTHSSAQIEFGLLNNHNSMSVAPAPGQGLSLSLNTHILAPSYPYWSAKTELLTPHSYHGDDNRMKNMQSEASQAIRNSKYLKAAQELLDEVVSVWKSIKQKAQKDQAEAGKSDNKEAEGGSKGEGVSSNPQESTANAAPEISAAEKQELQNKMAKLMAMLDEVDRKYKHYYHQMQIVVSSFDMVAGSGAAKPYTAVALQTISKHFRCLKDAINDQINVIRKKLGEEESSSGKEGKLTRLRYIDQQLRQQRAFQQYGLLQQNAWRPQRGLPENSVSILRAWLFEHFLHPYPKDSEKLMLARQTGLTRSQISNWFINARVRLWKPMIEDMYKEEIGEADLDSNSSSDNVPRSKDKIATSEDKEDLKSSMSQTYQPSQLGESKANIGMMSLGGAPAGFHNEGNQDDSFMNLMLKDQRPGEAEGSLLHDAVAHHSDENARFMAYHLSGLGRYGNSNVSLTLGLQHPDNRLSVQNTHQPGFAGAGEEIYNSTASLGVAAASSSDYESTNQIDQRQRFEPSPLMHDFVA

SEQ ID NO: 1377 - protein, 580 aa, Oryza sativa
MGGGGTLVDGFRRLFHRRTASGSNQSSNAGEEAASSDLEVADDPDLVALRSIRIRVPKRKMPLPVESHKKNTVEMEFFTEYGEASQYQIQEVIGKGSYGVVAAAVDTRTGERVAIKKINDVFEHVSDATRILREIKLLRLLRHPDIVEIKHIMLPPSRREFQDIYVVFELMESDLHQVIRANDDLTPEHYQFFLYQLLRALKYIHAANVFHRDLKPKNILANSDCKLKICDFGLARASFNDAPSAIFWTDYVATRWYRAPELCGSFFSKYTPAIDIWSIGCIFAELLTGRPLFPGKNVVHQLDIITDLLGTPSSETLSRIRNEKARRYLSTMRKKHAVPFSQKFRNTDPLALRLLERLLAFDPKDRSSAEEALADPYFASLANVEREPSRHPISKLEFEFERRKLTKDDVRELIYREILEYHPQMLQEYMKGGEQISFLYPSGVDRFKRQFAHLEENYSKGERGSPLQRKHASLPRERVGVSKDGYNQQNTNDQERSADSVARTTVSPPMSQDAQQHGSAGQNGVTSTDLSSRSYLKSASISASKCVAVKDNKEPEDDYISEEMEGSVDGLSEQVSRMHS

SEQ ID NO: 1378 - protein, 439 aa, Oryza sativa
MESRGKILMERYELGRLLGKGTFGKVHYARNLESNQSVAIKMMDKQQVLKVGLSEQIRREITTMRLVAHKNIVQLHEVMATRNKIYFVMEYVKGGELFEKVAKRGKLTEVVAHKYFQQLISAVDYCHSRGVYHRDLKPENLLLDENENLKVSDFGLSALSESKRQDGLLHTTCGTPAYVAPEVISKIGYDGAKSDIWSCGVILFVLVAGYLPFQGPNLMEMYRKIQHGEFRCPGWFSRKLQKLLYKIMDPNPSTRISIQKIKESTWFRKGPEENRILKERTLNENTTKNVALVLGVRRKKNAHEDVKPMSVTNLNAFEIISFSKGFDLSGMFIVKEWRNEARFTSDKSASTIISKLEDVAKALNLRVRKKDNGVVKMQGRKEGRNGVLQFDIEIFEVTTSYHIIEMKQTSGDSLEYRQLLEEGIRPALKDIVLAWHGDE

SEQ ID NO: 1379 - protein, 972 aa, Oryza sativa
MKIPFVTKWSHRSHEPAAPSNPAAQQQPPPPSPAGVSSAAAAAVVEEAEMETGGDDFITQEEEYQIQLAMALSASASVSAPSGGGGSGDTEGEQIRKAKLMSLGRGDLSAAADRGVGDSAEALSRRYRDYNFLDYNEKVIDGFYDIFGLSGESARQGKMPSLAELQTSIGDLGFEVIVVDHKFDSALQEMMEVAQCCMLGCPDTTVLVRRIAEVVAGHMGGPVIDATEMFTKWLGKSIEQRTSHQTSLLPIGRIDIGLSRHRALLFKILADSVGIPCKLVKGSHYTGVEDDAINIVKMNNEREFLVDVMAAPGTLIPADVFISKGTPFNLTKPLVQNQVVELASNIENDPSAAHSEHVGNRLHMFGNGNSLSENQSGCEKTMIAGSEVSQLWTLAPQMQSDQQSTSAGAHSMQKEDLKLTPDSQENEESKKQISETDSFRGIELGKSSLAFKGLNNRNNEYQRHRENIAPAPGRSQQPLVMKNWSACNDISNKQYNIAERLVRRRNTSDNAASSSQLAWSTAKHYNPNGRERNDRLCAAPGRNYDNRKVGASTTATASATGERLDRPNLAPVHYYDDKPNGISSVNAASTSGIVKVAEKGPHDLEKVPIYSRFDSQIYSSMQGYSPEVKENKENYDRHDNMRLHPDPRRSPLDRFMDTSRQNSESVSPPQAGSSTVDMVLGEVSECEILWEDLLIGERIGLGSYGEVYHADWNGTEVAVKKFLDQEFYGDALAEFRCEVRIMRRLRHPNIVLFMGAVTRPPHLSIVSEYLPRGSLYTIIHRPDCQIDEKCRIKMALDVARGMNCLHTSVPTIVHRDLKSPNLLVDNNWTVKVCDFGLSRLKHGTFLSSKSTAGTPEWMAPEVLRNEQSNEKCDVYSFGVILWELATLQMPWSGMNPMQVVGAVGFQDRRLDIPMEVDPLVASIIQDCWQKDPNLRPSFSQLTSYLNTLQRLVIPCHQETAGSYVPQEISLYR

SEQ ID NO: 1380 - protein, 1792 aa, Oryza sativa
MSQRGDRGEGHARRPGRSSSFGGGHRGGGGVGGAGKGGGGSSGQPPLATNRSFRKSGNGHGGHQRAVSQPDTHGFQPAPAPTALQTPPLRPPAPQNAPAHVPVPAPRPQHHDPSGARAPTLPPSSENTANAPPLKGIPHAAPRAPSRISSTSTSQGAPKGGAYNLQFGSFPMNGGTGGSTMQFPARTSSAPPNLDEQKRMQALPEGHKVVPSGLVPQAPKHQQQQQPLQQQKQQPQSQPPLQQTRKDVVSSNHSSKPINPHIPSQVKSSVHVSPSVPNVAPPRPPVQQIPGMPMSMPFHHQAPLQFGGHNPQIPPQGVVPSSLQMSMGLHGANAPQVAQQMYIPTIQHHHQLQPPTMMHQAAGIPYGPAAHQLTQMSGMMNVGVAPQFTPQQPNKYVTGPTRKTTVKITHPDTHEELKLDKRMDSSGQRGLPSVQQQSQPVSTYGSPMGFYQQNSYNQSTMFYPTTSGVGQVPTVSQGPRFVSTQTVSYISPSMNTGPGSNKDNLAGSTTSGHSQVTGKPHPAGLHMEKSGVQTVTISAPPGKSDVNKLKPAEDVVSHRQKDNEAVSGVRKSGENESKASPITEKHPTPVSQPLQALAANPETTAAASFVVNSVPGDDGKSKESIQRTGSFKDSNKNATKDTRNLSQEPQSASSAEDLKVHTSVKDVCCGVSLMESKGVNKESEQTNAASASPTEMLKAADASSIDRSSARSTSESTENVQEVGKSDVAIGDSEKSGITNKVSPDLTKDDISSGSTGNESHEVCTLDLAEQLPVGASNPDNLDTATSVTDQGQLLKEPSSSVSDENVIMDRSHQSAEKMSDLVDDTVASVASSETLPESIIQNANAKGNTSGNQETGSATSSNILNVLPVPHSVASEDPLKPESMLKDQSSSAPAASARPVSREKPSVEITRTKFTAVKKKKRREMLSKADAAGSSDLYNAYKGPEEKVDFIGASESLDSSSIADHELPDESSEKEVNMGEDEGKKKVELDDWEDAAEMSTPKLERSDSSNQTTEANGRKRYSRDFLLTLAQSCTNLPVGFQMIEYASVLFPNLAGKSYVVDHPSPGRGADRPASRGDRRGVVIEDDRWGKSGHLFGSGRDMSMDNGPPTMNHRGAPGVMRNPRGGLINVGPVAPQMSRSGSDADRWQQKGIFPSPVTPMQVMHKAEKKYVVGKVSDEEEAKQRQLKAILNKLTPQNFEKLFEKVKEVNIDNVATLTGVISQIFDKALMEPTFCEMYANFCFHLAGALPDFSEDNEKITFKRLLLNKCQEEFERGEREEAEADKTEEEGEIKQTKEEREEKRIRARRRMLGNIRLIGELYKKRMLTERIMHECIKKLLGNYQNPDEENIEALCKLMSTIGEMIDHAKAKEHMDAYFDIMLKLSTSQQLSSRVRFMLRDSIDLRKNKWQQRRKVEGPKKIDEVHRDAAQERHAQSSRLARGSVVGSGPRRGAAPMDYGPRGSAAALASPSSQQVGHRGMPSHSRGFGTQDIRFEERSPLDHRTTVLPPRKDEAITLGPQGGLARGMSIRGQPLISNAELSSADSRRMVSGPNGYNSASTAREEPGSRIPDRSGRIAPNTQFAGPSNRPASQEGRSGNKLYSEDDLREKSISAIREYYSAKDEKEVALCIEELNAPSFYPSVVSLWVNDSFERKDMERELLTKLFVSLCNSRNNLLSKSHLTAGLATVLGSLEDALSDAPRAAEYLGRLLARFVVESILSLQEVGTLIEKGGEEPGELVHHGIGADVLGAVLESIKVEKGDSFLNEAKASSNLKLEDFRPQHLKRSKLDAFMKA

SEQ ID NO: 1381 - protein, 165 aa, Oryza sativa
MLGHLVGLVKVRVVRGVNLAVRDLRSSDPYVIVRMGKQKLKTRVIKKTTNPEWNDELTLSIEDPAVPVRLEVYDKDTFIDDAMGNAELDIRPLVEVVKMKIEGVADNTVVKKVVPNRQNCLAEESTIYISEGKVKQDVVLRLRDVECGEIELQLQWVDIPGSKGV

SEQ ID NO: 1382 - protein, 274 aa, Oryza sativa
MENYVRKTQTVKMSQPAELSREENVYMAKLAEQAERYEEMVEFMEKVAKTVDSEELTVEERNLLSVAYKNVIGARRASWRIISSIEQKEESRGNEDRCTLIKEYRGKIETELSKICDGILKLLDSHLVPSSTAPESKVFYLKMKGDYYRYLAEFKTGAERKDAAENTMVAYKAAQDIALAELPPTHPIRLGLALNFSVFYYEILNSPDRACNLAKQAFDEAISELDTLSEESYKDSTLIMQLLRDNLTLWTSDISEDAAEEIKEAPKGESGDGQ

SEQ ID NO: 1383 - protein, 610 aa, Oryza sativa
MPEAPTAKTAPAYGYAPGAHAEALEFIEHVTANAGQVQRRVLGEILAQNAPAEYLRRYGIPGSPDVVDAFRRLVPLVTYEGLQPDILRIANGDTSPIFSGKPISEFLTSSGTSGGERKLMPTIADEMNRRSLLYSLLMPVMSQSVSGLDKGKAMYLLFVKAESRTPGGLAARPVLTSYYRSRQFLDRPRDPYTSYTSPDEAILCVDSYQSMYAQLLCGLVHRADVLRVGAVFASGFLRAIHFLEKHWARLCHDIRTGELDPEITDRVVRDAVGRVLRADPALADAIEDECARASWEGIIRRLWPRTKYIDVIVTGTMSQYIPTLEFYGGGLPLTCTMYASSECYFGLNLNPMCKPSDVAYTLIPTMCYYEFLPVNCNNATAEASHRDLVDLVDVKLGHEYELVVTTYSGLYRYRVGDVLRVAGFKNKAPMFSFVRRQNVALSVDSDKTDETELHAAVSGAVQHLAPFGASLVEYTSYADAATIPGHYVLFWELRAGSTAVPASVFEECCLSVEEALNSVYRQGRACDRSIGPLEIRVVAEGTFDKLMDYAISRGASINQYKAPRCVRPGPVVELLDARVQGKYFSPKCPKWSPGNKQWNKSKDLVGKGDA

SEQ ID NO: 1384 - protein, 614 aa, Oryza sativa
MAPAAVAAAEAGSKAAAVAGKAVAACERDAEKLEFIEEMTRGFDAVQERVLAAILARNNGAEYLRRHGMEGRTDREAFKARVPVVTYEDLRPEIERIANGDRSNIISSHPITEFLTSSGTSAGERKLMPTIEDELDRRQMLYSLLMPVMNLYVPGLDKGKGLYFLFIKSETKTPGGLPARPVLTSYYKSDHFKHRPFDPYNVYTSPTAAILCTDAFQSMYAQMLCGLVARAEVLRVGAVFASGLLRAIRFLQLHWRELAHDIRTGTLSAKVTEPSIRDAVAEVLAAPDAELAAFVEAECGKDKWEGIITRMWPNTKYLDVIVTGAMAQYIPTLKFYSGGLPMACTMYASSECYFGLNLRPMCDPSEVSYTIMPNMGYFELMPHDPDAPPLPRDAPPPRLVDLADAEVGREYELVITTYAGLCRYRVGDILQVTGFHNAAPQFRFVRRKNVLLSIDSDKTDEAELQAAVERASALLSPYGASIVEYTSQADATTIPGHYVVYWELMVREGGAWPPPAEEEGRGVFERCCLEMEEALNAVYRQGRNGEAIGPLEIRVVRAGTFEEVMDYAISRGASINQYKAPRCVSFGPIIELLNSRVISKHFSPACPKYSPHKK

SEQ ID NO: 1385 - protein, 605 aa, Oryza sativa
MAVMTDVSTTGTALRTPAAGAVKEGDVEKLRFIDEMTTNVDAVQERVLGEILGRNAGTEYLTKCGLDGATDRAAFRAKVPVVSYDDLQPYIQRIANGDRSPILSTHPVSEFLTSSGTSAGERKLMPTIMDELDRRQLLYSLLMPVMNLYVPGLDKGKGLYFLFVKSETKTPGGLTARPVLTSYYKSDHFKNRPYDPYHNYTSPTAAILCADAFQSMYAQMVCGLCQRNDVLRLGAVFASGLLRAIRFLQLNWEQLADDIESGELTPRVTDPSVREAVAAILLPDPELAKLIRAECSKGDWAGIITRVWPNTKYLDVIVTGAMAQYIPTLEFYSGGLPMACTMYASSECYFGLNLRPMCDPSEVSYTIMPNMGYFEFLPVDETGAASGDATQLVDLARVEVGREYELVITTYAGLNRYRVGDVLRVTGFHNAAPQFRFVRRKNVLLSIESDKTDEAELQRAVERASALLRPHGASVVEYTSQACTKRIPGHYVIYWELLTKGAGATVVDADTLGRCCLEMEEALNTVYRQSRVADGSIGPLEIRVVRPGTFEELMDYAISRGASINQYKVPRCVTFPPIVELLDSRVVSSHFSPALPHWTPARRSE

SEQ ID NO: 1386 - protein, 213 aa, Oryza sativa
MAKAVMMLPVLLSFLLLPFSSMALTQDFCVADLTCSDTPAGYPCKASVGAGDFAYHGLAAAGNTSNLIKAAVTPAFVGQFPGVNGLGISAARLDIAVGGVVPLHTHPAASELLFVTQGTVAAGFITSSSNTVYTRTLYAGDIMVFPQGLLHYQYNAGQSAAVALVAFSGPNPGLQITDYALFANNLPSAIVEKVTFLDDAQVKKLKSVLGGSG

SEQ ID NO: 1387 - protein, 334 aa, Oryza sativa
MASQGVASMFALALLLGAFASIPQKAEAIGVCYGMSANNLPPASSVVGMYRSNGITSMRLYAPDQAALQSVGGTGISVVVGAPNDVLSNLAASPAAAASWVRNNIQAYPSVSFRYVAVGNEVAGGATSSLVPAMENVRGALVSAGLGHIKVTTSVSQALLAVYSPPSAAEFTGESQAFMAPVLSFLARTGAPLLANIYPYFSYTYSQGSVDVSYALFTAAGTVVQDGAYGYQNLFDTTVDAFYAAMAKHGGSGVSLVVSETGWPSAGGMSASPANARIYNQNLINHVGRGTPRHPGAIETYVFSMFNENQKDAGVEQNWGLFYPNMQHVYPISF

SEQ ID NO: 1388 - protein, 877 aa, Oryza sativa
MQVQGFFDRLTGRNKEAWKEGRIRGTAVLVKKDVLGLGDFHASLLDGVHNILGHKEGVAFRLVSATARDPSNGGRGKLGKPAHLEELVVTMKSTAAGESVFRVAFEWDESQGIPGAVVVTNSNRSEFFLKTLTLDGVPGKGTVVFVANSWIYPADNYQYERVFFANDTYLPSKMPAPLIPYRQEELNILRGDGKIGPYKEHDRIYRYDYYNDLGQPDKGSKLVRPVLGGSQELPYPRRGRTGRAPTKTDPNTESRLPLLDLNIYVPRDERFGHLKMSDFLGYSLKAIVEGVLPIIRTYVDTTPKEFDSFQDIMELYEGGLKVANASALAEIKKRVPFELIKSLLPVAGDQVLKLPLPHVIKEDKFAWRTDEEFAREMLAGVNPVMIKRLTNFPAKSTLDPNVYGDHTSKITEAHIKHNMEGLTVQNALKGNRLFILDHHDHFMPFLDKINKLDGNFIYASRTILLLKDDGTLKPLAIELSLPHPDGQQHGAVSKVYTPANTGVESQIWQLAKAYASVNDSAWHQLISHWLNTHAVIEPFVIATNRQLSVVHPVHKLLSPHYRDTMNINALARQTLINADGIFEKTVFPGKYALEMSSVVYKNWKFTEQALPVDLVKRGVAVPDPTSPYNVRLLIKDYPYAVDGLVIWWAIERWVGEYLAIYYPNDGVLRGDEELQAWWKEVREVGHGDLKDQDWWPKMDTVQELTRACTIIIWIASALHAAVNFGQYPYAGFLPNRPTVSRRPMPEPGTEEYAKLERGGDEADLVFIHTITSQFQTILGISLIEILSKHSSDEVYLGQRDTPEWTSDAKALDAFKRFGSRLVDIENRIKDMNGNSALKNRNGPVKMPYMLLYPNTSDVTKEKGQGLTAMGIPNSISI

SEQ ID NO: 1389 - protein, 138 aa, Oryza sativa
MAGKKVQVCALFLALNVLFTMQMGAVVQACEPYCPTPTPPVTPPPSPPSGGGNKCPIDALKLSVCANVLNLLKLKIGVPESEQCCPLLGGLVDLDAAVCLCTAIKANILGINLNIPVDLSLLLNYCHKTCPSDFTCPL

SEQ ID NO: 1390 - protein, 503 aa, Oryza sativa
MFCRMDGHTNGTNGSCSKPCEPLTDYCIPDYILNPDSEQVLVDQAPCCPVVVFINSRSGGQLGSSLIKTYRELLNKAQVFDLSEEAPEKVLHRLYCNFEKLKSNGDPIAFQIQSNLRLIVAGGDGTASWLLGVVSDLKLSHPPPIATVPLGTGNNLPFSFGWGKKNPTTDQEAVKSFLGQVKKAREMNIDSWHIIMRMRAPQEGPCEPIAPLELPHSLHAFHRVSGSDSLNMEGYHTYRGGFWNYFSMGMDAQVSYEFHSERKRNPEKFKNQLTNQSTYAKLGLKQGWFAASLTHPSSRNIAQLAKVRIMKRPGGQWEELKIPRSIRSIVCLNLPSFSGGLNPWGTPGTRKVQDRDLTAPFVDDGLIEVVGFRDAWHGLVLLAPNGHGTRLAQAHRIRFEFHKGAAEHTFMRIDGEPWKQPLPKDDDTVVVEISHLRQVTMLASDPCKSKSVNDPSSPMCCSNHDDDERNSLEDEDEWEEGRKKFGAADTFKFPDEVDVAHLS

SEQ ID NO: 1391 - protein, 584 aa, Oryza sativa
MAGGGVVDGVRRWLRRRRGRTASAYQPLRSSSLARHPGGDGGLEVVPGPFALPAAIRVPARNSPPPPDAQLRNERTSDMEFFTEYGEASQYQIQEVVGKGSYGVVAAAVDTHTGERVAIKKINDVFEHVSDAIRILREIKVLRLLRHPDIVVIKHIMLPPTRREFRDIYVVFELMESDLHQVIEANHDLSPEHHRFFLYQLLCALKYIHSANVFHRDLKPKNILANSDCKLKICDFGLARVAFNDSPSTIFWTDYVATRWYRAPELCGSFFSKYTPAIDIWSIGCIFAEILTGRPLFPGRNVVHQLDLITDLLGTPSSETLSRIRNENARGYLTGMQRKHPIPFSHKFHNADPLALRLLERLLAFDPKDRPTAEEALADPYFRGISKLSREPSRLPVSKFEFEFERRKLTKDDVREMIYREILEYHPQMLQEYIRGGEQISFLYPSGVDRFKRQFAHLEENYSRGERSTPLRRQHASLPRERVCSSVDSNNQDSDNEERRAISSIARTMISPPRSQEKGKNRASAYPNGIINLNSNPKIYLKSASISASTCIIRGNKGPKENGISEDMEEVVYELSDNVTRMLS

SEQ ID NO: 1392 - protein, 638 aa, Oryza sativa
MRSSWADSAANAEESAPAAAANHGNSRLPRSSYVPPHLRGQAAPAAPAQAGALPSAAAAAQPSVGQPGVVGGPRWAGIVNGGGGGGGGSVGGSRQGFGAGGRGGGGGGGGGAWNSRPGGWDRRDREPDPFANSEAAEVDFEGENTGINFEAYEDIPVETSGHDVPPPANTFAEIDLGDALNENIRRCKYVKPTPVQRYAIPISIAGRDLMACAQTGSGKTAAFCFPIISGIMRSRPPPRSRGSRTAYPLALILSPTRELSVQIHEEARKFAYQTGVKVVVAYGGAPITQQLRELERGVEILVATPGRLMDLLERARVSLQMIKYLALDEADRMLDMGFEPQIRKIVEQMDMPPRGERQTMLFSATFPKEIQRMASDFLADYIFLAVGRVGSSTDLIVQRVEFVLDADKRSYLMDLLHAQRANGTHGKQALTLVFVETKRGADALENWLYNNGFPATSIHGDRTQQEREYALRSFKSGATPILVATDVAARGLDIPHVAHVINFDLPNDIDDYVHRIGRTGRAGKSGLATAFFNESNTPLARPLSELMQEANQEVPQWLERYAARSSFGGGGGRNRRSGGGARFGGRDFRRDRGSGGGGYGGGGGGYGGGGYGGGGGGGGYGGGSSYGGGGQGFSSAWD

SEQ ID NO: 1393 - protein, 468 aa, Oryza sativa
MGLLMRPVALLIYCTTASLFFLTSSSSAAIAGGTPDGSEEWGYVQVRPKAHMFWWLYRSPQRVNNKGSTPWPTVLWLQGGPGASGVGYGNFMEIGPLDTNLKPRPSTWLSKADLLFVDNPVGTGFSYVEGGDRTLLARTDAEAATDLTTLLSQLYRSNNTRLQGSPLYIVAESYGGKFAVTTALAALKAIHAGRLAASLAGVALGNSWISPEDSVLSWGPLLYQVSRLDENGLYLSDSLAQQIKAQVKAAQFLEAENTWQSLESIILEQANFIDFYNFLKDDSSSDANLEQQQRQRLLASLGQSRRRYSSYLSSKVTTEGGFEGIMNTVIRDKLRIIPKNVTWSEQSDDVFEALAGDFMKPRILEVDELLNLGLNVTIYSGQLDLICATKGTLDWIQKLKWDGLKNFTNSRRVPLYCSGGEAAGTQAFLKSYKNLKFYWILGAGHMVPIDNPCPALKMLGDITQSPAQ

SEQ ID NO: 1394 - protein, 580 aa, Oryza sativa; identical to SEQ ID NO: 1377

SEQ ID NO: 1395 - protein, 1021 aa, Oryza sativa
MLLHHLEDARRRGDARLWFFHTEAVVESAVLVEAAGMGNSGGEWAMPSQYPFHQPRMGPRSALAAAVVVAVAAEGDLDGGGWGRGRNRPRRWGRSSGSGGSPRGEDLQRGCSDVVAEHAGRRSKRGGGEAKSSRVEEEQRNIRAWMDRAVVKSCAQMDGGTVVLYDRKVVRNFRKDGHNWKKKKDGRTVQEAHEKLKIGNEERVHVYYARGEDDPNFFRRCYWLLDKDLERIVLVHYRQTAEENAMAPPNPEPEVADVPTVNLIHYTSPLTSADSTSGHTELSLPEEINSHGGISASSETGNHDSSLEEFWANLLESSIKNDPKVVTSACGGSFVSSQQINNGPKNSGNIVNTSMASNAIPALNVVSETYATNHGLNQVNANHFGALKHQGDQTQSLLASDVDSQSDQFISSSVKSPMDGNTSIPNEVPARQNSLGLWKYLDDDSPGLGDNPSSVPQSFCPVTNERLLEINEISPEWAYSTETTKVVVIGNFYEQYKHLAGSAMFGVFGEQCVAGDIVQTGVYRFMVGPHTPGKVDFYLTLDGKTPISEICSFTYHVMHGSSLEARLPPSEDDYKRTNLKMQMRLARLLFATNKKKIAPKLLVEGTKVANLMSALPEKEWMDLWNILSDPEGTYVPVTESLLELVLRNRLQEWLVEMVMEGHKSTGRDDLGQGAIHLCSFLGYTWAIRLFSLSGFSLDFRDSSGWTALHWAAYHGRERMVATLLSAGANPSLVTDPTPESPAGLTAADLAARQGYDGLAAYLAEKGLTAHFEAMSLSKDTEQSPSKTRLTKLQSEKFEHLSEQELCLKESLAAYRNAADAASNIQAALRERTLKLQTKAIQLANPEIEASEIVAAMKIQHAFRNYNRKKAMRAAARIQSHFRTWKMRRNFINMRRQVIRIQAAYRGHQVRRQYRKVIWSVGIVEKAILRWRKKRKGLRGIASGMPVVMTVDAEAEPASTAEEDFFQAGRQQAEDRFNRSVVRVQALFRSYKAQQEYRRMKIAHEEAKIEFSEGQLGAACRS

SEQ ID NO: 1396 - protein, 337 aa, Oryza sativa
MSSNFEANNNNGEKQLVCVTGAGGFIGSWVVKELLIRGYHVRGTARDPADSKNAHLLELEGADQRLSLCRADVLDAASLRAAFSGCHGVFHVASPVSNDPDLVPVAVEGTRNVINAAADMGVRRVVFTSSYGAVHMNPSRSPDAVLDETCWSDYEFCRQTDNLYCCAKMMAEMTATEEAAKRGLELAVVVPSMTMGPMLQQTLNFSSNHVARYLMGTKKSYPNAVAAYVDVRDVARAHVLVYERPDARGRYLCIGTVLHRAELLRMLRDLFPQYPATAKCEDDGKPMAKPYKFSNQRLKDLGLEFTPLRKSLHEAVLCMQQKSHLPLIYPVPKRAYL

SEQ ID NO: 1397 - protein, 286 aa, Oryza sativa
MVNGYLFREYIGAQFTGVRFSDVPVNPGLSFHFILAFAIDYFMATQSSKPAPANGVFAPYWDTANLSPAAVAAAKAAHPNLSVILALGGDTVQNTGVNATFAPTSSVDAWVRNAADSVSGLIDAYGLDGVDVDYEHFAAGVDTFVECIGRLLTELKARHPNIATSIAPFEHPVVQRYYQPLWRRYAGVIDYVNFQFYGYGANTDVATYVMFYDEQAANYPGSKLLASFKTGNVTGLLSPEQGIAGAKELQRQGKLPGLFIWSADSSMVSSYKFEYETKAQEIVANH

SEQ ID NO: 1398 - protein, 396 aa, Oryza sativa
MCGGAIISGFIPPSAAAAAAAAVAKKQQGRRVTADVLWPGMLRKGKAAAAEEDFEADFREFERGMSDDEAEGGGGEEEEDDDDVVVVVPPPAAARFVVRAAAKAAPPTADGMLTTKLVQHDGPTARSAKHKRKNQYRGIRQRPWGKWAAEIRDPSKGVRVWLGTYNTAEEAARAYDAEARKIRGKKAKVNFPDEPAVAQKLSLKQNAAKQEKLAPPLKTCGDDAFFQLNSSDNDLFAMLAKVPAKPAEPVDLMPPVKPLASTETFEMNMLSDTSSNSFGSSDFGWEDDTLTPDYTSVFVPNAAMPAYGEPAYLTGGAPKRMRNNYGIAVPQGNGMPNLAQNMPTFDPEMKYLPLPYVESSSDESMDNLLQNDATQDGASNEGIWSLDELLMAAGAY

SEQ ID NO: 1399 - protein, 172 aa, Oryza sativa
MQSQIVCHGCRNILLYPRGAPSVCCAVCHAVSSTAPSPGMDIAHLICGGCRTLLMYTRNATSVRCSCCDTVNLVRPVSSIAHLNCGQCQTVLMYPYGAPSVKCAICNFITNTGMNTMRHLPPNGTSYTAPSTSAPTTQSQNVTVVVENPMTVDAKGKLVSNVVVGVTTGGKK

SEQ ID NO: 1400 - protein, 398 aa, Oryza sativa
MDAGAQPPDTEMAEAGGGQQPPAAAAAAGAGAGAGMMENIQATLSHGGRFIQYNIFGNVFEVTAKYKPPILPIGKGAYGIVCSALNSETGEQVAIKKIANAFDNKIDAKRTLREIKLLRHMDHENIVAIRDIIPPPQRNSFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDVWSVGCIFMELMDRKPLFPGRDHVHQLRLLMELIGTPNEADLDFVNENARRYIRQLPRHARQSFPEKFPHVHPLAIDLVEKMLTFDPRQRITVEGALAHPYLASLHDISDEPVCSSPFSFDFEQHALSEEQMKDLIYQEGLAFNPDYQ

SEQ ID NO: 1401 - protein, 397 aa, Oryza sativa; identical to SEQ ID NO: 1074

SEQ ID NO: 1402 - protein, 369 aa, Oryza sativa
MRPGGPPSLRAGLQQQQQQQPGTPGRSRRRPDLTLPLPQRDLTSLAVPLPLPLPPSSAPSSTSSSGSSSLGGVPTPPNSVGSAPPAPPPLSELERVRRIGSGAGGTVWMVRHRPTGRPYALKVLYGNHDDAVRRQITREIAILRTAEHPAVVRCHGMYEQAGELQILLEYMDGGSLEGRRIASEAFLADVARQVLSGIAYLHRRHIVHRDIKPSNLLIDSGRRVKIADFGVGRILNQTMDPCNSSVGTIAYMSPERINTDLNDGAYDGYAGDIWSFGLSILEFYMGRFPLGENLGKQGDWAALMCAICYSDSPAPPPNASPEFKSFISCCLQKNPARRPSAAQLLQHRFVAGPQQQQQPQPQPLAPPPS

SEQ ID NO: 1403 - protein, 555 aa, Oryza sativa
MAGGGGGRALPETPTWAVAVVCAVIVLVSVAMEHGLHKLGHWFHKREKKAMGEALEKIKAELMLLGFISLLLTVAQTPISKICIPESAANIMLPCKAGQDIVKGLKGKKDHRRRLLWYTGEEESHRRSLAGAAGEDYCAQSGKVALMSSGGMHQLHIFIFVLAVFHVTYCVITMALGRLKMKKWKKWELETNSLEYQFANDPSRFRFTHQTSFVKRHLGLSSTPGLRWIVAFFRQFFGSVTKVDYLTMRQGFINAHLSQNSKFDFHKYIKRSLEDDFKVVVGISLPLWFVAILVLFLDIQGFGTLIWISFVPLVILMLVGTKLEMVIMEMAQEIQDRATVIKGAPVVEPSNKYFWFNRPDWVLFFIHLILFQNAFQMAHFVWTLATPGLKKCFHENMGLSIMKVVVGIFIQFLCSYSTFPLYALVTQMGSNMKKTIFEEQTMKALMNWRKTAREKKKLRDADEFLAQMSGDTTPSRGSSPVHLLHKQRVRSEDPPSAPASPGFAGEARDMYPVPVAPVVRPHGFNRMDPDKRRAASSSAIQVDIADSDFSFSVQR

SEQ ID NO: 1404 - protein, 252 aa, Oryza sativa
MAMTPQLAFSRMPPGFRFQPTDEQLVVDYLQRRTAAQPCVTPDITDIDVYNVDPWQLPAMAMYGSDHDRYFFTMAAREAQARRTTPSGFWKPTGTKKTIFVVAGGHEVPTAVKRRFVFYLGHHQPSGSNNNNKTSWIMHEYRLMNSPRAAVPSSSSVNRLPTDDLTEEMVLCRISNKDLPKPPFIHNSLLQFSSVGLNGDGYNYLILDHLEPPAMEYPNVGIGNVDDAAAGTDDPGDLDEEIDDSMQRNHGG

SEQ ID NO: 1405 - protein, 1046 aa, Oryza sativa
MEGGNHGGGGYPYPPPQQYPYPYGQYPYQYPPPQQQPPPPSAYLSPSRSFHGYPSAPPPQPQPQPYAHHSAPLQPYPPPPQHHAYPPPQPHPPSPYVYDPYHAPAAAYPSYPSPNPSPSISPSSSFHHHPEPPSPSPSAPSYPSIADGLANMHVSDRHDYPPPPSPAAVPAASSPSVLPPSASFPGGGSSHGGGGMQMVPYGPPAGGSQHGGMQMVAYGSPAGGSQHGSVRPSLKVVLLHGTLDVWVYDARNLPNKDLFSKRVGDLLGPRLIGAVGSKMSSANMTSDPYVTIQVSYATVARTYVVPNNENPVWTQNFLVPVGHDAAEVEFVVKDNDVFGAQLIGTVSIPAEKLLFGERINGIYDVLESNGKPCAQGAVLRLSIQYIPVAQLKMYHHGVIAGPDSLGVPNTYFPMRRGNRVTLYQDAHVPDGCLPDFCLDHGMRYQHGQCWRDIYDAICQARRLIYIVGWSVFHTIHLIREGVEKMPSLGELLKMKSQEGVRVLLLVWDDPTSRSILGIKTDGFMGTRDEETRRFFKHSSVQVLLCPRSAGKRHSWVKQQETGTIFTHHQKTVILDADAGNHKRKIIAFVGGLDLCGGRYDTPSHPLFRSLQTVHKEDYYNPNFATVDARGPREPWHDLHSKIDGPAAYDVLQNFQERWLKASKRHGIKKLGKSYDDALLSIERIPDFISINDAIYFSDNDPETWHVQVFRSIDSNSAKGFPKDPREATRKNLVCGKNVLIDMSIHTAYVNAIRGAQHFIYIENQYFIGSSFNWDSNKDIGANNLIPIEIALKIANKIKAKERFSAYIVIPMWPEGNPTGAPTQRILYWQHKTMQMMYETIYRALKEEGLDDLYEPQDYLNFFCLGNREVADSPSTSNSTSTPQEQARKHRRFMVYVHSKGMIVDDEYVIIGSANINQRSMEGIRDTEIAMGAYQPQYTWASKVSAPRGQIYGYRMSLWAEHIGVVEEGFNYPETMECMRRVRQIGEQNWERFVDNEVTEMRGHLMKYPVSVDRKGKVKPLPGCTSFPDMGGNICGSFRAIQENLTI

SEQ ID NO: 1406 - protein, 168 aa, Oryza sativa; identical to SEQ ID NO: 1122

SEQ ID NO: 1407 - protein, 214 aa, Oryza sativa; identical to SEQ ID NO: 1368

SEQ ID NO: 1408 - protein, 233 aa, Oryza sativa
MSTEAETTSAAAPAPAPAPASAPARCQRIGCDATFTDDNNPDGSCQYHPSGPMFHDGMKQWSCCKQKSHDFSLFLAIPGCKTGKHTTEKPITKAVPTKPSKAVPVQTSKQSVGADTCSRCRQGFFCSDHGSQPKAQIPTATSDTNMVPVEKPAVPPPKKKIDLNEPRVCKNKGCGKTYKEKDNHDEACDYHPGPAVFRDRIRGWKCCDIHVKEFDEFMEIPPCTKGWHNADAA

SEQ ID NO: 1409 - protein, 482 aa, Oryza sativa
MAAAANGAACCGGATGPGYATPLEAMEKGPREKLLYVTCVYNGTGINKPDYLGTVDVDPNSPTYSQVIHRLPVTHVGDELHHSGWNACSSCHGDPSASRRFLILPSLLSGRVYVVDTLKDPRAPALHKVVEAEDIAEKTGLGFPHTSHCLASGEIMISCLGDKEGNAAGNGFLLLDSEFNVKGRWEKPGHSPLFGYDYWYQPRHKTMISSSWGAPAAFRTGFDLQHVQDGLYGRHLHVYDWPGGELKQTLDLGSTGLLPLEVRFLHDPSKDTGYVGCALTSNMVRFFKTADGSWSHEVAISIKPLKVRNWILPEMPGLITDFVISLDDRYLYLVNWLHGDIRQYNIEDPAKPVLAGQVWAGGLLQKGSEVVYVTEDDKEEQYSVPQVKGHRLRGGPQMIQLSLDGKRIYVTNSLFSRWDEQFYGQDLVKKGSHMLQIDVDTEKGGLSINPNFFVDFGAEPEGPSLAHEMRYPGGDCTSDIWI

SEQ ID NO: 1410 - protein, 367 aa, Oryza sativa
MATAAASDLESKAKAAFVDDDFELAAELYTQAIEASPATAELYADRAQAHIKLGNYTEAVADANKAIELDPSMHKAYLRKGAACIRLEEYQTAKAALELGYSFASGDSRFTRLMKECDERIAEELSEVPVKKAEDGAAAPSVASFVEEKDDAANMDNTPPMVEVKPKYRHDFYNSATEVVLTIFAKGVPAENVVVDFGEQMLSVSIEVPGEEPYHFQPRLFSKIIPEKSRYQVLSTKVEIRLAKAEQITWTSLDYDKKPKAVPQKIIPPAESAQRPSYPSSKSKKDWDKLEAEVKKEEKEEKLEGDAALNKFFRDIYSDADEDMRRAMMKSFVESNGTVLSTNWKDVGSKKVEGSPPDGMELKKWEY

SEQ ID NO: 1411 - protein, 757 aa, Oryza sativa
MRERGEMREAKAPLIAEAAEHISHSHGSGSSGTGSHTSGGGGGWRGSRQYQRRSDALAYGNRYQKAAALVDLAEDGVGIPEDVLNDTRFERAMRFYFVYLRLDWLWSLNLFALILLNFLEKPLWCRGYSQHACDQRDLYFLGQLPYLSKTESLIYEGLTLVILVMDIFYPLSYEGLNLFWKNTINKLKVLLLFILACDILVFAFSPQPFRVAPYIRVAFLIMNIRELRMCAVTLVGMVGTYLNVLALSLLFLLFASWLAYVTFEDTPQGKTVFSSYGTTLYQMFILFTTSNNPDVWVPAYKSSRWSSLFFIVYVLLGVYFLTNLILAVIYDSFKEQLAKQVSQADCTRKSILEKAFGIIDATGQGYLNKEQCLSLLDELNKYRSLPKTSREDFELIFAELDQSGDFKVTSEEFATLCNTIAIKFQKEPPPSYLEKYPSFYHSALCEWLKSFVRSPLFEYIVIFVLLMNLVAVIIETTLDIENSSSQKVWQEVEFVFGWIYVIEMALKIFSLGFGAYWMEGQNKFDFVLTWTIFIGETLTFAFPSKLSFLSNGEWIRYLLLGRMLRLTRILLQVRRFRAFVATFFTLMSSLMPYLGIVFCTLCIYCSLGLQIFGGIVYAGNPTLEETDLFSNDYLLFNFNDYPSGMVTLFNLLVMGNWQAWMESYRQLTGSYWSLIYFVSFYLISVLLLLNLIVAFVLEAFFAEMELEKDGEADIQDPTLEGRNRRRSVRVRTKGTMVDILLHHMLSNELDGSQNRDQ

SEQ ID NO: 1412 - protein, 668 aa, Oryza sativa
MHPTLLCLPLLASLLLLCHRARAECEPATCGNLTVRYPFWLGGPNFNQSNQSSPSSALASCGHPAFEVWCNGGVASLRGSQILVLSIDYNSSSFVAAHKRVADGGDGVCRTDFNISSSLALSPFTISSSNRAICFLYSCNGTEPPEIDGLVNATISSCSKPIYAYLGGIYDRDNPPAIKAGNCTYSYLPVLWPDSPANLTAGTNYSPQFKKGFVLEWQKNGFGDCDACNGSGGQCRYINDSAAAFACLCSDGKLRRSTCPGSRSKSHIIGIACGSSGGILLIVSIFIFAWHKRKKRKQTRDLKDLMHSSSSMQSYSKDLELGGSPHIFTYEELEEATAGFSASRELGDGGFGTVYKGKLRDGRVVAVKRLYKNNYRRVEQFLNEVDILSRLLHQNLVILYGCTSRSSRDLLLVYEYIPNGTVADHLHGPRAGERGLTWPVRMTIAIETAEALAYLHAVEIIHRDVKTNNILLDNNFHVKVADFGLSRLFPLEVTHVSTVPQGTPGYVDPVYHQCYKLTDKSDVYSFGVVLIELISSKPAVDMSRSHSDINLANMALNRIQNHEVDQLVDPEIGYETDSETKRMVDLVAELAFQCLQMDRESRPPIKEVVEVLNCIKNGECPAEKMNKNASPKEDSHLLKDSLQYSPDSVIHRFHSQSTNHSVASNSSG

SEQ ID NO: 1413 - protein, 326 aa, Oryza sativa; identical to SEQ ID NO: 1360

SEQ ID NO: 1414 - protein, 219 aa, Oryza sativa
MAASLGLCHETSYAYSYPASNTSSSLCFPPLMADHIVDGGGGGGCSFGEFLELGHSVYSLPLPPPPSQPVVVAGGNNDQYGVSSSSSAAATTSRIGFRTRSEVEVLDDGFKWRKYGKKAVKSSPNPRNYYRCSAAGCGVKKRVERDGDDPRYVVTTYDGVHNHATPGCVGGGGHLPYPTSAAPPWSVPAAAASPPPAHAQAWGAPLHAAAAAHSSESSF

SEQ ID NO: 1415 - protein, 393 aa, Oryza sativa
MLPPPSQSVPSRPPSWLYIPPRRRHGTFTSSCAFRLSPSSPSSPPPPVLDFQYIQFMDSWIEQTSLSLDLNVGLPSTARRSSAPAAPIKVLVEENFLSFKKDHEVEALEAELRRASEENKKLTEMLRAVVAKYTELQGQVNDMMSAAAAAAVNAGNHQSSTSEGGSVSPSRKRIRSVDSLDDAAHHRKPSPPFVAAAAAAAYASPDQMECTSAAAAAAAKRVVREDCKPKVSKRFVHADPSDLSLVVKDGYQWRKYGQKVTKDNPCPRAYFRCSFAPACPVKKKVQRSADDNTVLVATYEGEHNHAQPPHHDAGSKTAAAAKHSQHQPPPSAAAAVVRQQQEQAAAAGPSTEVAARKNLAEQMAATLTRDPGFKAALVTALSGRILELSPTKN

SEQ ID NO: 1416 - protein, 326 aa, Oryza sativa; identical to SEQ ID NO: 1360

SEQ ID NO: 1417 - protein, 261 aa, Oryza sativa
MATVGQPDAMRRITVHYVNPPPIAGAGEAHVDGLDDEVLDYVIGDVLQDQEGLYQSILYGKYGDDMRGARNTALAQSDGLHYYYHGENSSGEATTSRNSEIDQQIEYDLVFARQLQAMDNLTIETPADEDDDISCVPSPSDSETDEPAEGNNEEAATQDDNDDPDNMTYEQRQALVESVGNENRGLSDLLISYLETWKYKSGFFPRKANHDNCPICLSAFRRRETLITLACKHSYHEGCIARWLKIDKACPVCKYEVFGPS

SEQ ID NO: 1418 - protein, 329 aa, Oryza sativa
MEDQKKNAKPEGSSGSQRGAPPAPDAGLPNPFDFSQFSNLLNDPSIKEMAEQIASDPVFTQMAEQLQKSAHVTGEQGGPALDPQQYMETMTQVMQNPQFMSMAERLGNTLMQDPGMSSMLESLTSPSHKELLEERMSRIKEDPSLKGILDEIESGGPSAMVKYWNDPEVLQKIGQAMSINFPGDAATSTTLSGPEETEEDGGDDDESIVHHTASVGDAEGLKKALEDGADMDEEDAEGRRALHFACGYGELKCAEILLEAGAAVNALDKNKNTPLHYAAGYGRKECVDLLLKHGAAVTPQNLDGKTPIEVAKLNNQDEVLKVLEMDAFL

SEQ ID NO: 1419 - protein, 320 aa, Oryza sativa
MRALALAVVAMAVVAVRGEQCGSQAGGALCPNCLCCSQYGWCGSTSDYCGAGCQSQCSGGCGGGPTPPSSGGGSGVASIISPSLFDQMLLHRNDQACAAKGFYTYDAFVAAANAYPDFATTGDADTCKREVAAFLAQTSHETTGGWPTAPDGPYSWGYCFKEENNGNAPTYCEPKPEWPCAAGKKYYGRGPIQITYNYNYGPAGQAIGSDLLNNPDLVASDATVSFKTAFWFWMTPQSPKPSCHAVITGQWTPSADDQAAGRVPGYGEITNIINGGVECGHGADDKVADRIGFYKRYCDMLGVSYGDNLDCYNQRPYPPS

SEQ ID NO: 1420 - protein, 434 aa, Oryza sativa; identical to SEQ ID NO: 1007

SEQ ID NO: 1421 - protein, 533 aa, Oryza sativa
MGNCFTKTYEIPITSGTMRRPASTAERSKARGGDEPGTWRRPSFPRHGAPPHRPPTGSSSAAGALSRRASGGGGEMGPVLQRAMVSVRSLYQLDRKLGSGQFGTTYLCTERATGNRYACKSVSKRKLVRRTDVDDVRREITILQHLSGQPNIAEFRGAYEDNDHVHLVMEFCSGGELFDRITAKGSYSERQAAAVCRDILTVVHVCHFMGVIHRDLKPENFLLASADDDAPLKAIDFGLSVFIEEGKVYKDIVGSAYYVAPEVLQRNYGKEADIWSAGVILYILLCGTPPFWAETEKGIFDAILVNQVDFSTSPWPSISESAKDLIRQMLHRDPQKRITASQALEHRWLKEGGASDRPIDSAVLSRMKQFKAMNKLKQLALKVIAENLSPEEIKGLKQMFNNMDTDRSGTITVEELKVGLTKLGSRISEAEVQKLMEAVDVDKSGSIDYSEFLTAMINKHKLEKEEDLLRAFQHFDKDNSGYITRDELEQAMAEYGMGDEANIKQVLDEVDKDKDGRIDYEEFVEMMRKGIQT

SEQ ID NO: 1422 - protein, 1017 aa, Oryza sativa; identical to SEQ ID NO: 1373

SEQ ID NO: 1423 - protein, 235 aa, Oryza sativa; identical to SEQ ID NO: 933

SEQ ID NO: 1424 - protein, 212 aa, Oryza sativa; identical to SEQ ID NO: 1040

SEQ ID NO: 1425 - protein, 284 aa, Oryza sativa
MGQALGLVQVDQSTVAIKESFGKFDEVLEPGCHFLPWCIGKQIAGYLSLRVQQLDVRCETKTKDNVFVNVVASVQYRALAEKASDAFYRLSNTREQIQSYVFDVIRASVPKMNLDDAFEQKNEIAKAVEDELEKAMSMYGYEIVQTLIVDIEPDEHVKRAMNEINAAARLRVAANEKAEAEKILQIKRAEGDAESKYLAGLGIARQRQAIVDGLRDSVLAFSENVPGTSAKDVMDMVLVTQYFDTMKEIGASSKSSSVFIPHGPGAVKDIAAQIRDGQLQAKLI

SEQ ID NO: 1426 - protein, 213 aa, Oryza sativa
MGAGALGVVAMVAAAVVVAMAGANSEGDALSALRRSLRDPGGVLQSWDPTLVNPCTWFHVTCDRDNRVTRLDLGNLNLSGHLVPELGKLDHLQYLELYKNNIQGTIPSELGNLKNLISLDLYKNNISGTIPPTLGKLTSLVFLRLNGNRLTGPIPRELAGISSLKVVDVSSNDLCGTIPTSGPFEHIPLSNFEKNPRLEGPELQGLAVYDTNC

SEQ ID NO: 1427 - protein, 370 aa, Oryza sativa
MAIMVDPPNGMGNQGKYYYSMWQTLFEIDTKYVPIKPIGRGAYGIVCSSINRETNEKVAIKKIHNVFDNRVDALRTLRELKLLRHLRHENVIALKDIMMPVHRRSFKDVYLVYELMDTDLHQIIKSPQGLSNDHCQYFLFQLLRGLKYLHSAEILHRDLKPGNLLVNANCDLKICDFGLARTNSSKGQFMTEYVVTRWYRAPELLLCCDNYGTSIDVWSVGCIFAELLGRKPIFPGTECLNQLKLIVNVLGTMSESDLEFIDNPKARRYIKSLPYTPGVPLASMYPHAHPLAIDLLQKMLIFDPTKRISVTEALEHPYMSPLYDPSANPPAQVPIDLDIDENISADMIREMMWHEMLHYHPEVVAAMSAR

SEQ ID NO: 1428 - protein, 397 aa, Oryza sativa; identical to SEQ ID NO: 1074

SEQ ID NO: 1429 - protein, 376 aa, Oryza sativa
MDSSSGGAGGGGGAQIKGMGTHGGRYVLYNVYGNFFEVSSKYAPPIRPIGRGAYGIVCAAVNSENGEEVAIKKIGNAFDNHIDAKRTLREIKLLRHMDHENIIAIKDIIRPPRRDNFNDVYIVSELMDTDLHQIIRSNQPLTDDHCQYFLYQLLRGLKYVHSANVLHRDLKPSNLFLNANCDLKIADFGLARTTTETDLMTEYVVTRWYRAPELLLNCSQYTAAIDVWSVGCILGEIVTRQPLFPGRDYIQQLKLITELIGSPDDSSLGFLRSDNARRYMKQLPQYPRQDFRLRFRNMSAGAVDLLEKMLVFDPSRRITVDEALHHPYLASLHDINEEPTCPAPFSFDFEQPSFTEEHIKELIWRESLAFNPDPPY

SEQ ID NO: 1430 - protein, 582 aa, Oryza sativa
MEPPTSHVTNAFSDSDSASVEEGGADADADVEALRRLSDNLAAAFRSPEDFAFLADARIAVPGGGGGGGDLLVHRCVLSARSPFLRGVFARRAAAAAGGGGEDGGERLELRELLGGGGEEVEVGYEALRLVLDYLYSGRVGDLPKAACLCVDEDCAHVGCHPAVAFMAQVLFAASTFQVAELTNLFQRRLLDVLDKVEVDNLLLILSVANLCNKSCMKLLERCLDMVVRSNLDMITLEKSLPPDVIKQIIDARLSLGLISPENKGFPNKHVRRIHRALDSDDVELVRMLLTEGQTNLDDAFALHYAVEHCDSKITTELLDLALADVNHRNPRGYTVLHIAARRREPKIIVSLLTKGARPADVTFDGRKAVQISKRLTKQGDYFGVTEEGKPSPKDRLCIEILEQAERRDPQLGEASVSLAMAGESLRGRLLYLENRVALARIMFPMEARVAMDIAQVDGTLEFNLGSGANPPPERQRTTVDLNESPFIMKEEHLARMTALSKTVELGKRFFPRCSNVLDKIMDDETDPVSLGRDTSAEKRKRFHDLQDVLQKAFHEDKEENDRSGLSSSSSSTSIGAIRPRR

SEQ ID NO: 1431 - protein, 582 aa, Oryza sativa; identical to SEQ ID NO: 1430

SEQ ID NO: 1432 - protein, 462 aa, Oryza sativa
MAAAAMAPSPPEPALPRELSLGDLRAVSMLGRGAKGVVFHVVPAAAGEEEASMALKAVSREAARHKKNGSGGEDGHRRIWFERDVLMSLRHPLLPSLRGVLATDAVVGFAIDRCGGGDLNSLRRRQTEKMFSDSVIRFYAAELVLALDYLHSLGIVYRDLKPENVLIQDSGHIMLVDFDLSTRLPTPPPPPEEQDATIADSMPEPPPSSPSPNRAKGKRQPGAASCFPFCSVGATKPAASADSPSPTSTSRTASASSSSSSSTATTASSSTAAGVRSPAKSNSFVGTEDYVAPEIIAGSGHDFSVDWWGLGVVLYEMLYGRTPFRGLNRKETFYRVLSKQPELVGEKTPLRDLIARLLEKDPEKRIGARGIKAHPFFNGVDWDRILRVARPPFIPPPPEDEDEAGEVLDVEKVVNEVFAANDGGAAAGVVEKPSPEAGGTLAVGDGEQRRDPSKEGDFSVFF

SEQ ID NO: 1433 - protein, 469 aa, Oryza sativa
MASSERGGGGGIHVVLLPYPSQGHINPILQFGKRLAGHGGVRCTLAVTRFILRQGEPPSTGAVHVAAYSDGYDAGGFHEAGSAGEYLSRLESRGSDTMDALLRAEAEQGRPVDAVVYDSFLSWAPRVAARHGAATASFFTQACAVNAAYESVFTGRVELPLAADGEEPLRLPGISVGLTLDDVPTFMANTEDSPAYLDLLVNQFKGLDMADHVLVNSFYELQPQEAEHMASAWRAKTVGLTVPSAYLDNRLPDDTSYGFHLFSPTTETKAWLEARPPRTVAYVSFGSVATPSPAQMAEVAEGLYNTGKPFLWVVRASETSKIPEGFAAKAAKQGRGLIVTWCPQLEVLAHPAVGCFVTHCGWNSTTEGLSAGVPMVAVPQWSDQTMNAKYIEDVWRVGVRVRPDGEGVVRKEELERCVREVMEGERSKEFMENANGWKEKARNAMCEGGSSDKNIVEFIAKIGVDRKFK

SEQ ID NO: 1434 - protein, 414 aa, Oryza sativa
MNLCSIIIGGDQFKNDIMELYPGYLEDHFNIHKLSISSASPPEYMTSASTQFAAPVRMGAYDRPPPVGMWSHEQFKVDNGQATSASTIMEAEMKFENRLEEIPQVVLEEGRNVDQEASKPPDKVLRRLAQNREAARKSRLRKKAYIQQLETSRLKLAQLEQELQRARQQAVYANGSLREPNLGFTGPIDPGALGFEIKYSHWVDEQNRNTGELRNALLQGQTTDQDLELKLLVEAGLDNYNRLFEMKEEAANSDVFYIMSGMWKTPTERFFLWIGGFRPSEVLKNLRPQLEPLTDKQVVEVGGLQQTSMQVEDALSQGMDKLKQTIADSLTAADPFDSPEAYMVHMANAVEQLRSLVQFVTQADHLRQQTLQEMHRILTTRQAARGLLALGDYFQRFRALSSLWAARPRDSGIS

SEQ ID NO: 1435 - protein, 318 aa, Oryza sativa; identical to SEQ ID NO: 1166

SEQ ID NO: 1436 - protein, 348 aa, Oryza sativa
MDPWISTQPSLSLDLRVGLPATAAVAMVKPKVLVEEDFFHQQPLKKDPEVAALEAELKRMGAENRQLSEMLAAVAAKYEALQSQFSDMVTASANNGGGGGNNPSSTSEGGSVSPSRKRKSESLDDSPPPPPPPHPHAAPHHMHVMPGAAAAGYADQTECTSGEPCKRIREECKPKISKLYVHADPSDLSLVVKDGYQWRKYGQKVTKDNPCPRAYFRCSFAPACPVKKKVQRSAEDNTILVATYEGEHNHGQPPPPLQSAAQNSDGSGKSAGKPPHAPAAAPPAPVVPHRQHEPVVVNGEQQAAAASEMIRRNLAEQMAMTLTRDPSFKAALVTALSGRILELSPTKD

SEQ ID NO: 1437 - protein, 327 aa, Oryza sativa; identical to SEQ ID NO: 1356

SEQ ID NO: 1438 - protein, 1426 aa, Oryza sativa; identical to SEQ ID NO: 1247

SEQ ID NO: 1439 - protein, 845 aa, Oryza sativa
MQMCGWLLKVVRWENLNCVHMEAHGNRRSSPTYLVMLWMISVASLLITCRGSIQKQVLFPGFTAAQMDYIDNDGIFLLSNGSVFGFGFVTSNVSDNTFYILAVVHMATTTTVWSANPNSPVTHSDDFFFDKDGNAFLQSGGGSNVWAANISGKGTATSMQLLDSGNLVVLGKDASSPLWQSFSHPTDTLLSGQNFIEGMTLMSKSNTVQNMTYTLQIKSGNMMLYAGFETPQPYWSAQQDSRIIVNKNGDSIYSANLSSASWSFYDQSGSLLSQLVIAQENANATLSAVLGSDGLIAFYMLQGGNGKSKFSITVPADSCDMPAYCSPYTICSSGTGCQCPLALGSFANCNPGVTSACKSNEEFPLVQLDSGVGYVGTNFFPPAAKTNLTGCKSACTGNCSCVAVFFDQSSGNCFLFNQIGSLQHKGGNTTRFASFIKVSSRGKGGSDSGSGKHNTIIIVIMLGTLAIIGVLIYIGFWIYKRKRHPPPSQDDAGSSEDDGFLQTISGAPVRFTYRELQDATSNFCNKLGQGGFGSVYLGTLPDGSRIAVKKLEGIGQGKKEFRSEVTIIGSIHHIHLVKLRGFCTEGPHRLLAYEYMANGSLDKWIFHSKEDDHLLDWDTRFNIALGTAKGLAYLHQDCDSKIVHCDIKPENVLLDDNFIAKVSDFGLAKLMTREQSHVFTTLRGTRGYLAPEWLTNYAISEKSDVYSYGMVLLEIIGGRKSYDPSEISEKAHFPSFAFKKLEEGDLQDIFDAKLKYNDKDGRVETAIKVALWCIQDDFYQRPSMSKVVQMLEGVCEVLQPPVSSQIGYRLYANAFKSSSEEGTSSGMSDYNSDALLSAVRLSGPR

SEQ ID NO: 1440 - protein, 1290 aa, Oryza sativa
MAEVVLAGLRLAATPICVKLLCNASTCLGVDMTRELHELETIIIPQFELVIEAAEKGNHRAKLDRWLRELKQAFYNAEDLLDEHEYNILKCKAKHKDSLVKDSTQVHDSSISNILKQPMRAVSSRMSNLRPENRKILCQLNELKTMLEKAKEFRELIHLPAGNSLEGPSVPTIVVPVVTSLLPPRVFGRNMDRDRIIHLLTKPMATVSSSVGYSGLAIVAHGGAGKSTLAQCVYNDKRVQEHFDVRIWVCISRKLDVHRHTREIIESATNGECPRVDNLDTLQCRLKDIMQKSEKFLLVLDDVWFDESVNEREWDQLLDPLVSQQEGSRVLVTSRRDVLPAALHCKDVVHLENMEDAEFLALFKYHAFSGTEIRNPQLHARLEEVAEKIAKRLGQSPLAARTVGSQLSRNKDIAIWKSALNIENLSEPMKALLWSYNKLDSRLQRCFLYCSLFPKGHKYKIDEMVDLWVAEGLVDSRNQGDKRIEDIGRDYFNEMVSGSFFQPVSERYMGTWYIMHDLLHDLAESLTKEDCFRLEDDGVKEIPATVRHLSICVDSMKFHKQKICKLRYLRTVICIDPLMDDGDDIFNQLLKNLKKLRVLHLSFYNSSSLPECIGELKHLRYLSIISTLISELPRSLCTLFHLELLHLNDKVKNLPDRLCNLRKLRRLEAYDDRNRMYKLYRAALPQIPYIGKLSLLQDIDGFCVQKQKGYELRQLRDMNKLGGNLRVVNLENVTGKDEASESKLHQKTHLRGLHLSWNDVDDMDVSHLEILEGLRPPSQLEDLTIEGYKSTMYPSWLLDGSYFENLESFTLANCCVIGSLPPNTEIFRHCMTLTLENVPNMKTLPFLPEGLTSLSIEGCPLLVFTTNNDELEHHDYRESITRANNLETQLVLIWEANSDSDIRSTLSSEHSSMKKLTELMDTDMSGNLQTIESALEIERDEALVKEDIIKVWLCCHEERMRFIYSRKAGLPLVLPSGLCVLSLSSCSITDGALAICLGGLTSLRNLFLTEIMTLTTLPPEEVFQHLGNLRYLVIRSCWCLRSFGGLRSATSLSEIRLFSCPSLQLARGAEFMQMSLEKLCVYNCVLSADFFCGDWPHLDDILLSGCRSSSSLHVGDLTSLESFSLYHFPDLCTLEGLSSLQLHHVHLIDVPKLTTESISQFRVQRSLYISSSVMLNHMLSAEGFVVPEFLSLESCKEPSVSFEESANFTSVKCLRLCNCEMRSPPGNMKCLSSLTKLDIYDCPNISSIPDLPSSLQHICIWGCELLKESCRAPEGESWPKIAHIRWKEFR

SEQ ID NO: 1441 - protein, 359 aa, Oryza sativa
MSELQSLLDLNRLWLLSLVNLEKVSDTEDARMAKLQEKEKLETLMLRWNMDAGNASRIDHEVLETLQPNQCLKTLEIVAYEGHAFPSWITSTEPYLTSLVEIRLVNLRSCENALPPLGLLPCLKIEVEISRVENISCIDDNFYGQNGTFPSLEKLILSFMTSLEVWEQSSRMNLFPRLAELVIIQCPKLRALHMEFPSIEKLILWMNNKMLYSSKEGLRGVEKSLENLSISFCEELHASSGCEGLQALDRLKKLEICGCHELSCLPQGLQHLSSLASLKIDNCNKLEILPEWLENLPFLQIMCLSGCPILHSIPEGLTCSDIIVEYCPNFKEPSGMSSVLCSWKAMFLIFIELFLKQLN

SEQ ID NO: 1442 - protein, 1144 aa, Oryza sativa
LLVRDHRPKISARRWRAAPMAVYSVATGALAPVLSKLSALLGDEHLDLAERTRSDAMFIRSQLEAVHSLLLPRISWGMTGEEVDALCKDELMAEVRELSYDMDDAIDEFFLEEPMAGGDGGPFDELKTRVEDVSKRFSDSRRWRPPVEQHQPSLTAATVDCPPPHARFVHNMMDVSELVEMDKQHEKELIKLLEQGADTSIYASRWRIATPWHDKEQSTVVKVPEREWGFPDNRNSPFIWASDSFERLRSGSLCGDTLRLDGEGANIRKLLSTLRNKVGRAQLVQVEDKRKRVEEATKPCEFHEVKTICILGLPGAGKTTLAKLLYSHHSTTEQQFQHRAFVSLSPGANLTDTLTDILLQVGAYNDDATPYCGTGTPHQQYLIDNISAYLIGKKYLIIIDDVWHWEEWEVIRKSIPKNDLGSRIIMTTRLNSIAEKCRNDDMDAFVYETEALDYVDAWLLCDKVARKSVTCMNINPCYDIVDMCYGMPLALIRVSSALAEEIQALDSDERQIWRALRRVEDGILDIPSLKPLAESLCLGYDHLPLYLRTLLLCCSVYHWLDGGIVQRGRLVTRWIAEGFVSEEKAAEGYFDELVGRGWMKHRGLNEYEIHPMMLAILRYKSKEYNFVTCLGTGSDTCTSASLSYSSPTMAIRRLCLQRGYPMKCFSSMDVSHTRSLVILGDVIGVPLDMFKRLRVLDLEDNIGIEDSHLKKICEQLESLRLLKYLGLKGTRITKLPQEIQKLKQLEILYVRSTGIEELPWEIGELKQLRTLDVRNTRISELPSQIGELKHLRTLDVSNMWNISELPSQIGELKHLQTLDVRNTSVRELPSQIGELKHLRTLDVRNTGVRELPWQAGQISGSLHVHTDDSDEGMRLPEGVCEDLIKGIPKAELAKCSEVLSINIVDRLGSPPIGIFKVIGLHKSIPKLIKDHFNVLSSLDIRRYNKLEEDDHEFLANNMPNLQMLVLRFEAPQREPIIINRTGFQMLERFLVESRVPRITFQEGAMPKLKHLEFKFYAGPPSKDPIGITHLKSLQKVVFRCSKWYKSDNPGIKAAIDVVKKEARQHPNRPISLLITEGDKEVPNIEAHGSSENIVVVHAAPDDAISCSSCGRTSTSIQEGTVRDRIPAMDLFWPEFNSYEKAKRN

SEQ ID NO: 1443 - protein, 1033 aa, Oryza sativa; identical to SEQ ID NO: 1353

SEQ ID NO: 1444 - protein, 197 aa, Oryza sativa
MSASRFIKCVTVGDGAVGKTCMLISYTSNTFPTDYVPTVFDNFSANVVVDGSTVNLGLWDTAGQEDYNRLRPLSYRGADVFLLAFSLISKASYENVSKKWIPELRHYAPGVPIILVGTKLDLRDDKQFFVDHPGAVPISTAQGEELRKLIGAAAYIECSSKTQQNIKAVFDAAIKVVLQPPKQKKKKKKAQKGCAIL

SEQ ID NO: 1445 - protein, 334 aa, Oryza sativa
MAGAQESLVLAGVMHGHNDVVTAIATPIDNSPFIVSSSRDKSLLVWDLTNPVQNVGEGAGASEYGVPFRRLTGHSHFVQDVVLSSDGQFALSGSWDGELRLWDLSTGVTTRRFVGHDKDVLSVAFSVDNRQIVSASRDRTIKLWNTLGECKYTIGGDLGGGEGHNGWVSCVRFSPNTFQPTIVSGSWDRTVKVWNLTNCKLRCNLEGHGGYVNAVAVSPDGSLCASGGKDGVTLLWDLAEGKRLYSLDAGSIIHSLCFSPNRYWLCAATQDSIKIWDLESKHIVQDLKPEIPVSKNQMLYCTSLNWSADGSTLYAGYTDGTIRIYKISGFSYAG

SEQ ID NO: 1446 - protein, 336 aa, Oryza sativa
MAGQESLTLAGVLRGHNDMVTAIAAPIDNSPFIVSSSRDKSLLVWDITNPSTAVATDPEAAPPEYGVSYRRLTGHSHFVQDVVLSSDGQFALSGSWDGELRLWDLATGRTTRRFVGHTKDVLSVAFSVDNRQIVSAARDNTIKLWNTLGECKYTIGGDHGAGEGHTGWVSCVRFSPNPMAPTIVSGSWDRSVKVWNLTNCKLRTKLEGHNGYVNAVAVSPDGSLCASGGKDGTTLLWDLTEGKMLYKLDAGAIIHSLCFSPNRYWLCAATEDSVKIWDLESKLVMQDLKPEVQAFKSQMLYCTSLSWSADGSTLFAGYTDGTIRVWKVSGFGGYAI

SEQ ID NO: 1447 - protein, 326 aa, Oryza sativa
MRALAVVAMVATAFLAAAVHAEQCGSQAGGAVCPNCLCCSQFGWCGSTSDYCGAGCQSQCSAAGCGGGGPTPPSGSGGSGVASIVSRSLFDQMLLHRNDAACPASNFYTYDAFVAAASAFPGFAAAGGDADTNKREVAAFLAQTSHETTGGWATAPDGPYAWGYCFKEENGGAAGPDYCQQSAQWPCAAGKKYYGRGPIQLSYNFNYGPAGQAIGADLLGDPDLVASDATVSFDTAFWFWMTPQSPKPSCHAVATGQWTPSADDQAAGRVPGYGVITNIINGGLECGHGEDDRVADRIGFYKRYCDILGVSYDANLDCYSQRPFGS

SEQ ID NO: 1448 - protein, 329 aa, Oryza sativa
MQEPKHTDPAAMRGAHHRRARSEVAFRLPDDLDLGGGGAGAFDEIGSEDDLFSTFMDIEKISSGPAAAGGSDRDRAAETSSPPRPKHRHSSSVDGSGFFAAARKDAAASLAEVMEAKKAMTPEQLSELAAIDPKRAKRILANRQSAARSKERKARYITELERKVQTLQTEATTLSAQLTLFQRDTTGLSAENAELKIRLQAMEQQAQLRDALNDALKQELERLKLATGEMTNSNETYSMGLQHVPYNTPFFPLAQHNAARQNGGTQLPPQFQPPRPNVPNHMLSHPNGLQDIMQQDPLGRLQGLDISKGPLVVKSESSSISASESSSTF

SEQ ID NO: 1449 - protein, 650 aa, Oryza sativa
MAPVSLPPGFRFHPTDEELIIYYLKRKINGRQIELEIIPEVDLYKCEPWDLPEKSFLPSKDLEWYFFSPRDRKYPNGSRTNRATKAGYWKATGKDRKVNSQRRAVGMKKTLVYYRGRAPHGSRTDWVMHEYRLDERECETDTGLQDAYALCRVFKKTAPGPKIIEHYGVVHHHVEQPQWMTSSIDRSPTLDVSCDGRGDDFESSSFSFPTETPMDSMHGGFGMQMSAPHEDGKWMQFLSEDAFNATNPFLTNPVSANFSCLPSKVDVALECARLQHRLTLPPLEVEDFPQDVSLDTKIGILRSNPNEVDILQEFLSVATASQELINGSTSSYPEMWLGASTSSASYVNELSSLVEMGGVGTSNHHESARLQVEIADMEVFKDEKKRVENLRGVKLVNNDLGEIVVEGDESNPTEDIIAQYPIKVTADNSGEAGHRMTDPTDVGGIDTAPIFSQSQPDDFAAGFDDVNPNASFDLYEKVDVNHRLFVSRVAAAKTFFHRIEPSKKVSFHSNPAATAVSKATEKFHFPVTTKVSGRVSIFSKFKALIRDKFLMMRPSHSYQRLGSKETTVNELLQIVSLLLAPKQINGCPTEQELVKKKAKEVMKPGWGREGSNKLWLPLSKGKGISSMFLSGKWTFLTSALAISTPAECDH

SEQ ID NO: 1450 - protein, 793 aa, Oryza sativa
MEKDHQPVISLRPGGGGGGPRPGRLFSPAFAAAASGSGDLLRSHVGGASKIGDPNFEVRERVRYTRDQLLELREIVDIPEAILRINQEIDIELHGEDQIWGRPESDVQVQTQTQAQPHNRYGETDNRDWRARTVQPPAANEEKSWDNIREAKAAHASSGRQQEQVNRQDQLNHQFASKAQVGPTPALIKAEVPWSARRGNLSEKDRVLKTVKGILNKLTPEKFDLLKGQLMESGITTADILKDVISLIFEKAVFEPTFCPMYAQLCSDLNEKLPSFPSEEPGGKEITFKRVLLNNCQEAFEGAESLRAEIAKLTGPDQEMERRDKERIVKLRTLGNIRLIGELLKQKMVPEKIVHHIVQELLGSGPDKKACPEEENVEAICQFFNTIGKQLDENPKSRRINDTYFIQMKELTTNLQLAPRLRFMVRDVVDLRSNNWVPRREEIKAKTISEIHDEAMKTLGLRPGATGLTRNGRNAPGGPLSPGGFPMNRPGTGGMMPGMPGTPGMPGSRKMPGMPGLDNDNWEVPRSKSMPRGDSLRNQGPLLNKPSSINKPSSINSRLLPHGSGALIGKSALLGSGGPPSRPSSLMASLTHTPAQTAPSPKPVSAAPAVVPVTDKAAGSSHEMPAAVQKKTVSLLEEYFGIRILDEAQQCIEELQCPEYYSEIVKEAINLALDKGPNFIDPLVRLLEHLHAKKIFKTEDLKTGCLLYAALLEDIGIDLPLAPALFGEVVARLSLSCGLSFEVVEEILKAVEDTYFRKGIFDAVMKTMGGNSSGQAILSSHAVVIDACNKLLK

SEQ ID NO: 1451 - protein, 980 aa, Oryza sativa; identical to SEQ ID NO: 1139

SEQ ID NO: 1452 - protein, 402 aa, Oryza sativa
MLKNTHCSIATPRVLEFYSVFAMDGVEEANMAAVESSKKLVAILSKSGDPFRLMAAVAETDEAVSRFGKVVTILSNRVGHARARLGKRRSSPPVDPGCLMDHPLAAAASSPAPSNGRLHFSSSAATASPSPATAAAASSAANVTPAVVDRSLFLETTLLDLNSRGAPAPAASMAAAAKNSSKLAPAPMVNSSSSANHIQFQQPMKSFQFEQTPISDKFHIEMPRGVGGGGGKEVISFSFDNSVCTSSAATSFFTSISSQLISMSDAATNSAAAAAAPTTKKPSSCARKATADDDAGGKCHCPKKKKPREKKVVTVPAISDKVADIPSDNYSWRKYGQKPIKGSPHPRGYYRCSSKKDCPARKHVERCRSDPAMLLVTYENEHNHAQPLDLSVVQQATANPQT

SEQ ID NO: 1453 - protein, 348 aa, Oryza sativa; identical to SEQ ID NO: 1436

SEQ ID NO: 1454 - protein, 307 aa, Oryza sativa
MAGGFLSMANPAVTLSGVAGNIISFLVFLAPVATFLQVYKKKSTGGYSSVPYVVALFSSVLWIFYALVKTNSRPLLTINAFGCGVEAAYIVLYLVYAPRRARLRTLAFFLLLDVAAFALIVVTTLYLVPKPHQVKFLGSVCLAFSMAVFVAPLSIIFKVIKTKSVEFMPIGLSVCLTLSAVAWFCYGLFTKDPYVMYPNVGGFFFSCVQMGLYFWYRKPRNTAVLPTTSDSMSPISAAAAATQRVIELPAGTHAFTILSVSPIPILGVHKVEVVAAEQAADGVAAAAAADKELLQNKPEVIEITAAV

SEQ ID NO: 1455 - protein, 198 aa, Oryza sativa
MGWRWHDDGDDGGRGLGDIPDLAGGGGGGDGERCATRRVVQSRCHTEEVEPGRFVRKCEKTEQLLRDCVGRPSELVESKTENTEEDVTDEMKSGSLSLGFPTNEPFAFPGLRSDIEALEKGLFGSIGSFLDDAERMTNDFLKSFGVPSINERESSSFDGQPTGRHIGGQPAGRHIEEGTAKDTKQNDYAEFSSKITDV

SEQ ID NO: 1456 - protein, 450 aa, Oryza sativa
MGHGVSCARTGDEHDFFRAAQLGDLDALAALLAADPSLARRATLYDRLSVLHIAAANGRIEVLSMFLDRGAPPDAVNRHKQTPLMLAAMHGKIDCVLKLLQADANILMFDSVHARTCLHHAAYYGHVDCLQAILAAAQTTPVADSWGFARFVNVRDDHGATPLHLAARQGRPGCVQVLLENGAIVSALTGSYGFPGSTSLHLAARSGNLDCIRKLLAWGADRLQRDSAGRIPYSVALKRNHGACAALLNPTSAEPMVWPSPLKFISELEPEAKALLEAALMEANREREKKILNGTKYSLPSPSPGDDSADDDACSEVSDTELCCICFDQACTIEVQDCGHQMCAPCTLALCCHNKPNPTTLTPPSPACPFCRGSISRLVVAQTRSACDPDKPSSLQLTRKRSRRSHNLSEGSSSFKGLPSAMGSFSKLGRGSSRMADSDSSNLDKPEHDL

SEQ ID NO: 1457 - protein, 233 aa, Oryza sativa
MAAVSEVEVDGVVFPPVARPPGSGHAHFLAGAGVRGVEIAGNFIKFTAIGVYLEEGAAVPALAKKWAGKSADELAADAAFFRDVVTGDFEKFTRVTMILPLTGEQYSDKVTENCVAAWKAAGVYTDAEGAAADKFKEAFKPHSFPPGASILFTHSPPGVLTVAFSKDSSVPEGAVAAAAIENRALCEAVLDSIIGEHGVSPAAKRSIAARVSQLLKAESTGDVAAAEPAPVSA

SEQ ID NO: 1458 - protein, 407 aa, Oryza sativa
MDALCDFCREQRSMVYCRSDAASLCLSCDRNVHSANALSRRHTRTLLCDRCVGQPAAVRCLEENTSLCQNCDWNGHGAASSAAGHKRQTINCYSGCPSSAELSRIWSFSMDIPTVAAEPNCEEGINMMSINDNDVNNHCGAPEDGRLLDIASTALMSDLPTGDKFKPLIGSSSGDGMNLLPLNSDQPAEPVSTTPKAPCVTDKDMFNDGSVYGDFCVDDADLTFENYEELFGTSHVQTEQLFDDAGIDSYFEMKDVPADESNEQPKPVQPECSNVASVDSGMSNPAARADSSHCIPGRQAISNISLSFSGLTGESSAGYFQDCGVSSMILMGEPPWHPPGPESSSAGGSRDNALTRYKEKKKRRKFDKKIRYASRKARADVRKRVKGRFVKAGEAYDYDPLSQTRSY

SEQ ID NO: 1459 - protein, 475 aa, Oryza sativa
MLLSDLSSDQEATGSNSHGGGGGDRMVVGSHGAAHVVLSNLFLPPAAAAAATMLLPAAPVMVRPAAMAAAQEPRAKKKRSLPGNPDPEAEVIALSPRALVATNRFVCEVCNKGFQRDQNLQLHRRGHNLPWKLRHRAAAVSAVTTAAPAPRKRVYVCPEPTCVHHDPARALGDLTGIKKHFSRKHGEKRWRCERCGKRYAVHSDWKAHVKNCGTREYRCDCGILFSRKDSLLTHRAFCDALAEESARLLAAANNSSSITTTTCNNSNISSNNNNNNINSISNSNNLLITSSSSSPPLFLPFSTTPAENPNPNQLLFLQQHQAAHHQLLLPQFQQPPSSPPAYFDHLAFGGGGGVITGSSCNDDNSSIAGDVMVAAGGDSVSFGLTSEGSVTMHAGDVGRRRLTRDFLGVDHDAGEVDELELDELPADLSTTAAACQGCNFAAATTAACCATDFTTGSRQYLGRLPPVNETWSHNF

SEQ ID NO: 1460 - protein, 563 aa, Oryza sativa
MGSQNRPPPPRKRQPPPPEDHLVTYKRRRSKETQPLPLMANGANSKKDAKAQHWISWRDTLHGFLQSPAISQGGGIQTCIRHALQHNPCLLTNGVVVHTEFKGNPAHSQGEEAKVQHPNGAAGGKVVSADAAIQDAAAAASSEANKAMCNNALFDILVSQKFALLCHLLLGTFHVNKPGDVIDLEKIDAKMRNGDYAHNPALFDDDIQQMWEKFEQVGQEMTGLASNLSTISRVSYQKQASGFSEAEVAEHRIEEISLPGAVHVVTKESTTTVQLAPCDSSHSTIPKRTVPPGRDLCPCDGCGTKVDVEEGLICDECDTMYHFACVKLLNPDIKQVPAIWHCSTCSFKKKELAADTTNNVAHDCLHGGNCVLCDQLELVKTEEEDPKLPIKIELAEEREGSSVSSMGEDNEPDLSTTALSNLCKHCGTCEDDDKRFMVCGHPYCVYKFYHIRCLKTSQLAIEQQKKLGCWYCPSCLCRGCFQDKDDDQIVMCDGCDEGYHIYCMRPARNTIPKGKWYCTFCKIRRAAEGMHKYEDSVLKIHGNSKHACNVNQSKDSEGDGTEK

SEQ ID NO: 1461 - protein, 1808 aa, Oryza sativa
MEGAAAAAGGGEMLSPGEADWPPELRLPPPPPPSAASEGEPPPARAAVGMDDSQFLGSIIGLPAQPPQATAEALAVVGVKRRRGRPPKKRDGAAAATAVVPAARPARRREDEEEVVCFICFDGGNLVVCDRRGCPKVYHPACIKRDEAFFQSRSKWNCGWHICSSCEKAVHYMCYTCTYSLCKVCIKQGKFFSVRGTKGFCDTCYSTILLIESKDEGDTKIVVDFDDQNSWEYLFKLYWVDLKGKLSLTLEELTSAKARWNAPTTYTRKEKDESSDDLYDANNDDDAGSDCSSGKRKRNSSRKKGRKRRKPNSDCSIATKKVETVTRDDGTLPNKVPTEEASLPVDTKWASPELLEFVGHMRDGDQSFISQFDVQALLLDYIKQNNLRDPQRKSQIICDSRLHRLFRKTRVAHFEMLKLLEMHFIVSEPSAVNDGSQGIINPDSAQIDHASGYNDMAAKFSPDRRRRMHRKMEREPQANPEDYAAIDMHNINLIYLRRSLMEDLIDDPTLSDKISGAFVRIRISGLGQKQDMYRLVKVVGTHKVSEKYSIGKKMTNFALEIMNLNKKEIITMDTVSNQDFTEEECKRLRQSMKYDLISRLKVGDIQEKAKIFQFVRVNDWFENEKQKLCHLRDRASETGRRKELRECVEKLQLLNTPEERARRINEVLDVHVDSHMDPDYESDDEFGNKKAVERSVNWARSDPFVSPVKVKYSNSSQKNGDATRHLKNLSKQNTERKSGAARNFENSHSPVGMDIPKSGTNVKSTRCETTSPSSHGVVSSDMEPEKVWHYKDPSGNVQGPFTLVQLSKWTSYFPRDMRVWLTFESEERSLLLTEVLSKQPKDFGQPASVTTSSKSTVADTGQNRNTEIVDLNKAPSPVGYSMLNSFETTVQSTKHSAPERESVNSLDDRLSHSTDSVPPKDANASNSQAMCQIKHSGSLPSPGSPHQRSDLHHDEVQGGRSGEWNNQHNSELWSPSMPQTSSSAHSNVESHHDHYPSWSQVQHDPKNSLQAGSGKDLNSRYDIAQKLPSQRITRDVPSPVFAWSPSESRTASSQHEGSCLSSTTNLCTHDELHSSIASAKAKSFAPATPVEDRGSSSPSGMLSLSERAPICSPQSAPSASASDTCKMEENMNQQKTLEADISNTSVNQSPQSKILPESSPDNQDAEHEYRSPPPISESKELSPQSRTTPGSSPDNQDTEREYPSPPPISGSKEISPQSRTILESSPDNQDNGHEYPSPPPIPESIELSPHSKALPESSPDNQDIEPECPSPPQIPESKELSRQSKILPESSPGNQDIEPECPSPPQIPESKELSQQSKILPESSPDNHDIKCEYSSPTPIPESKELSLQSKILPESSSDNQDIKCEDPSPTPISKSKEVSPQSKILSESYLDNQDVERECPSSILITESKELAVDLPGSISLAPEKTASTDVGENSSLAFIFPKSTLAGDDALKSVFDMAKAHLECEDSKVKEELYVESTVVIRDDMVVNPASGVESIDMSENLLESLMEQSCGTFYMDGTTALEGFLSGSTKEEPQCSSPIALSTCSSPIALSPWGEHGYYQGDSVGSSLWGVQDDDPIGNIWPLSSQAPALQYSSAGSTAHFIDEATVTHGNNGVVLSSTPGEEVGLPNSGVCTDWGLVEQVNPETNDASVSMIDKNSGLVDSQPSANDGSDVGTARNTNHNTNLSLNHETAVPLSRSSGEASRKHGFITDLNVATSEEALGNTKNWNPYAGNANRGSQRNHHRDRYSQISESWLLSSNYSRSRSDGFGTGGSSRSTPRGQTQRGICKFHENGYCRKGASCNYLHP

SEQ ID NO: 1462 - protein, 763 aa, Oryza sativa; identical to SEQ ID NO: 1236

SEQ ID NO: 1463 - protein, 395 aa, Oryza sativa
MNYNFGGNVFDQEVGVGGEGGGGGEGSGCPWARPCDGCRAAPSVVYCRADAAYLCASCDARVHAANRVASRHERVRVCEACERAPAALACRADAAALCVACDVQVHSANPLPAITIPATSVLAEAVVATATVLGDKDEEVDSWLLLSKDSDNNNNNNNNNDNDNNDNNNSNSSNNGMYFGEVDEYFDLVGYNSYYDNRIENNQDRQYGMHEQQEQQQQQQEMQKEFAEKEGSECVVPSQITMLSEQQHSGYGVVGADQAASMTAGVSAYTDSISNSISFSSMEAGIVPDSTVIDMPNSRILTPAGAINLFSGPSLQMSLHFSSMDREARVLRYREKKKARKFEKTIRYETRKAYAEARPRIKGRFAKRSDVQIEVDQMFSTAALSDGSYGTVPWF

SEQ ID NO: 1464 - protein, 341 aa, Oryza sativa
MDHRELWPYGLRVLVIDDDCSYLSVMEDLLLKCSYKVTTYKNVREAVPFILDNPQIVDLVISDAFFPTEDGLLILQEVTSKFGIPTVIMASSGDTNTVMKYVANGAFDFLLKPVRIEELSNIWQHIFRKQMQDHKNNNMVGNLEKPGHPPSILAMARATPATTRSTATEASLAPLENEVRDDMVNYNGEITDIRDLGKSRLTWTTQLHRQFIAAVNHLGEDKAVPKKILGIMKVKHLTREQVASHLQKYRMQLKKSIPTTSKHGATLSSTALDKTQDHPSRSQYFNQDGCKEIMDYSLPRDDLSSGSECMLEELNDYSSEGFQDFRWDSDKQEYGPCFWNF

SEQ ID NO: 1465 - protein, 707 aa, Oryza sativa
MPELRGGVWRARLRSKKVYDVQDADPAASPVSPAPRGRTGRRGGAAAGRGNKTVAEGGGRKALKPRGKGCRAVDLCKDQPCKDLPEVIARKAVTGKAQEDLGLNKVADRAANLMMDGESGDKFAAAEDESTTTPVPERVQVGNSPEYITDRKLGKGGFGQVYVGRRVSGGGSRTGPDAQEVALKFEHRSSKGCNYGPPYEWQVYHTLNGCYGIPSVHYKGRLGDYYILVMDMLGPSLWDVWNSVGQAMSAHMVACIAVEAISILEKLHSKGFVHGDVKPENFLLGHPGSVDEKKLFLIDLGLASRWKEASSGQHVDYDQRPDVFRGTIRYASVHAHLGRTGSRRDDLESLAYTLIFLIRGRLPWQGYQGDNKSFLVCKKKMATSPELLCCFCPAPFKHFLEMVTNMKFDEEPNYPKLISLFDGLIEGPASRPIRIDGALKVGQKRGRMVVNLDDDEQPKKKVRLGSPATQWISVYNARRPMKQRYHYNVADSRLHQHIEKGNEDGLYISCVSSSANFWALIMDAGTGFCSQVYELSQVFLHKDWIMEQWEKNYYITAIAGATNGSSLVVMSKGTPYTQQSYKVSESFPYKWINKKWKEGFHVTSMATAGNRWGVVMSRNAGYSHQVVELDFLYPSEGIHRRWETGYRITSTAATPDQAAFILSIPKRKPMDETQETLRTSSFPSNHVKEKWSKNLYIASICYGRTVC

SEQ ID NO: 1466 - protein, 760 aa, Oryza sativa
MATRGGGGGGGGKEAKGKVMGPLFPRLHVNDAAKGGGPRAPPRNKMALYEQFTVPSHRFSGGGGGGGVGGSPAHSTSAASQSQSQSQVYGRDSSLFQPFNVPSNRPGHSTEKINSDKINKKISGSRKELGMLSSQTKGMDIYASRSTAEAPQRRAENTIKSSSGKRLADDDEFMVPSVFNSRFPQYSTQENAGVQDQSTPLVAANPHKSPSTVSKSSTKCYNTVSKKLERIHVSDVKSRTPLKDKEMEAAQTSKNVEVEKSSSFHASKDMFESRHAKVYPKMDKTGIINDSDEPHGGNSGHQATSRNGGSMKFQNPPMRRNEISSNPSSENTDRHYNLPQGGIEETGTKRKRLLEQHDAEKSDDVSRLLEQHDAENIDDVSDSSVECITGWEISPDKIVGAIGTKHFWKARRAIMNQQRVFAVQVFELHKLVKVQKLIAASPHVLIESDPCLGNALLGSKNKLVEENLKAQPLLVATIDDVEPSLQQPEVSKENTEDSPPSPHDTGLGSGQRDQAATNGVSKSNRRATPVASDNKQNNWGVQLQPPQNQWLVPVMSPLEGLVYKPYSGPCPPAGSILAPFYANCTPLSLPSTAGDFMNSAYGVPMPHQPQHMGAPGPPSMPMNYFPPFSIPVMNPTAPAPVVEQGRHPSMPQPYGNFEQQSWISCNMSHPSGIWRFHASRDSEAQASSASSPFDRFQCSGSGPVSAFPTVSAQNNQPQPSYSSRDNQTNVIKVVPHNSRTASESAARIFRSIQMERQRDD

SEQ ID NO: 1467 - protein, 742 aa, Oryza sativa
MMGTAHHNQTAGSALGVGVGDANDAVPGAGGGGYSDPDGGPISGVQRPPQVCWERFIQKKTIKVLLVDSDDSTRQVVSALLRHCMYEVIPAENGQQAWTYLEDMQNSIDLVLTEVVMPGVSGISLLSRIMNHNICKNIPVIMMSSNDAMGTVFKCLSKGAVDFLVKPIRKNELKNLWQHVWRRCHSSSGSGSESGIQTQKCAKSKSGDESNNNNGSNDDDDDDGVIMGLNARDGSDNGSGTQAQSSWTKRAVEIDSPQAMSPDQLADPPDSTCAQVIHLKSDICSNRWLPCTSNKNSKKQKETNDDFKGKDLEIGSPRNLNTAYQSSPNERSIKPTDRRNEYPLQNNSKEAAMENLEESSVRAADLIGSMAKNMDAQQAARAANAPNCSSKVPEGKDKNRDNIMPSLELSLKRSRSTGDGANAIQEEQRNVLRRSDLSAFTRYHTPVASNQGGTGFMGSCSLHDNSSEAMKTDSAYNMKSNSDAAPIKQGSNGSSNNNDMGSTTKNVVTKPSTNKERVMSPSAVKANGHTSAFHPAQHWTSPANTTGKEKTDEVANNAAKRAQPGEVQSNLVQHPRPILHYVHFDVSRENGGSGAPQCGSSNVFDPPVEGHAANYGVNGSNSGSNNGSNGQNGSTTAVNAERPNMEIANGTINKSGPGGGNGSGSGSGNDMYLKRFTQREHRVAAVIKFRQKRKERNFGKKVRYQSRKRLAEQRPRVRGQFVRQAVQDQQQQGGGREAAADR

SEQ ID NO: 1468 - protein, 257 aa, Oryza sativa; identical to SEQ ID NO: 949

SEQ ID NO: 1469 - protein, 297 aa, Oryza sativa
MKSRKSYGHLLSPVGSPPLDNESGEAAAAAAAGGGGCGSSAGYVVYGGGGGGDSPAKEQDRFLPIANVSRIMKRSLPANAKISKESKETVQECVSEFISFVTGEASDKCQREKRKTINGDDLLWAMTTLGFEAYVGPLKSYLNRYREAEGEKADVLGGAGGAAAARHGEGGCCGGGGGGADGVVIDGHYPLAGGLSHSHHGHQQQDGGGDVGLMMGGGDAGVGYNAGAGSTTTAFYAPAATAASGNKAYCGGDGSRVMEFEGIGGEEESGGGGGGGERGFAGHLHGVQWFRLKRNTN

SEQ ID NO: 1470 - protein, 242 aa, Oryza sativa
LLDIVRDQHSKTPSLIFEYVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTEALNAYLNKYHIELDPQLEALVGRHSRKPWSKFINADNQHLVSPEAVDFLDKLLRYDHQDRLTAREAMAHPYFLQVRAAENSRARPQ

SEQ ID NO: 1471 - protein, 335 aa, Oryza sativa
MLKLEPEFPGLPQRCDSCRSAPCAFYCLADSAALCATCDADVHSVNPLARRHRRVPMGVVAAPGAGGAFVVRPAGGVNSSWPIREGRRCDYDDDDADAAGEEDEEATSWLLFDPLKDSSDQGLPPFGDALVADFLNLGGGAGEKEDASSSKDCSSSHGKSSEGSHEFAVPGEPVPERQGFGAVSMDITDYDASNFRRGYSFGASLGHSVSMSSLENMSTVPDCGVPDITTSYLRSSKSTIDLFTAAAGSPVAAHSIMSPPQFMGAIDREARVHRYREKRKTRRFEKTIRYASRKAYAETRPRIKGRFAKRSDTDLEVDQYFSTTADSSCGVVPTF

SEQ ID NO: 1472 - protein, 332 aa, Oryza sativa
MEAVEDKAMVGVGGAVAAGYSSSSWGLGTRACDSCGGEAARLYCRADGAFLCARCDARAHGAGSRHARVWLCEVCEHAPAAVTCRADAAALCAACDADIHSANPLARRHERLPVAPFFGPLADAPQPFPFSQAAADAAAAREEDADDDRSNEAEAASWLLPEPDDNSHEDSAAAADAFFADTGAYLGVDLDFARSMDGIKAIGVPVAPPELDLTAGSLFYPEHSMAHSLSSSEVAIVPDALSAGSAAPPMVVVVASKGKEREARLMRYREKRKNRRFDKTIRYASRKAYAETRPRIKGRFAKRTADADDDDEAPCSPAFSALAASDGVVPSF

SEQ ID NO: 1473 - protein, 440 aa, Oryza sativa; identical to SEQ ID NO: 1282

SEQ ID NO: 1474 - protein, 1160 aa, Oryza sativa
MSASNEKWIDGLQFSSLFWPPPQDSQQKQAQILAYVEYFGQFTADSEQFPEDIAQLIQSCYPSKEKRLVDEVLATFVLHHPEHGHAVVHPILSRIIDGTLSYDRNGFPFMSFISLFSHTSEKEYSEQWALACGEILRVLTHYNRPIFKVDHQHSEAECSSTSDQASSCESMEKRANGSPRNEPDRKPLRPLSPWITDILLAAPLGIRSDYFRWCGGVMGKYAAGGELKPPTTAYSRGSGKHPQLMPSTPRWAVANGAGVILSVCDEEVARYETANLTAAAVPALLLPPPTTPLDEHLVAGLPPLEPYARLFHRYYAIATPSATQRLLFGLLEAPPSWAPDALDAAVQLVELLRAAEDYDSGMRLPKNWMHLHFLRAIGTAMSMRAGIAADTSAALLFRILSQPTLLFPPLRHAEGVELHHEPLGGYVSSYKRQLEVPASEATIDATAQGIASMLCAHGPDVEWRICTIWEAAYGLLPLSSSAVDLPEIVVAAPLQPPTLSWSLYLPLLKVFEYLPRGSPSEACLMRIFVATVEAILRRTFPSETSEQSRKPRSQSKNLAVAELRTMIHSLFVESCASMDLASRLLFVVLTVCVSHQALPGGSKRPTGSDNHSSEEVTNDSRLTNGRNRCKKRQGPVATFDSYVLAAVCALSCELQLFPFISKNGNHSNLKDSIKIVIPGKTTGISNELHNSISSAILHTRRILGILEALFSLKPSSVGTSWSYSSNEIVAAAMVAAHVSELFRRSRPCLNALSALKQCKWDAEISTRASSLYHLIDLHGKTVTSIVNKAEPLEAHLTLTPVKKDEPPIEEKNINSSDGGALEKKDASRSHRKNGFARPLLKCAEDVILNGDVASTSGKAIASLQVEASDLANFLTMDRNGGYRGSQTLLRSVLSEKQELCFSVVSLLWQKLIASPEMQMSAESTSAHQGWRKVVDALCDIVSASPTKASAAIVLQAEKDLQPWIARDDEQGQKMWRVNQRIVKLIAELMRNHDSPEALVILASASDLLLRATDGMLVDGEACTLPQLELLEVTARAVHLIVEWGDSGVSVADGLSNLLKCRLSTTIRCLSHPSAHVRALSMSVLRDILNSGQINSSKLIQGEHRNGIQSPTYQCLAASIINWQADVERCIEWEAHSRRATGLTLAFLTAAAKELGCPLTC

SEQ ID NO: 1475 - protein, 416 aa, Oryza sativa
MYMDAFGWSAPAAPCQPSCGPGGDDDDDVLLAAVLGASFELHSLVDGGGNGAAGAVRSDDAYGLDVDLPSHQMSLLRCQDGLSALHGDASPTAAAAAFLDSVDVLPVPAIAGATHDDGGLLDRFAFPNVAETTTVQAAASNTAFSGYSSNTTGGGNISSGESNTYTEVASTPCAVSTTTTTTALPPSKRKLPEKYPVVGTSPTTKTTTTSETAAERRSTKRGAGGSSSITFGGGCHGAGAAAALLGYGRGYEPDTEAIAQVKEMIYRAAAMRPVTLGGPASASDPSSRPPPPPQRPRRKNVRISSDPQTVAARLRRERVSERLRVLQRLVPGGSKMDTATMLDEAASYLKFLKSQLEALETLGNGNGNGNLLHHGYYTGSRNATATAATGSSNSTVLAFGRDGLAGFVKSNRNLQL

SEQ ID NO: 1476 - protein, 416 aa, Oryza sativa
MRGEERWQEQPALASHPSRATLRPRGWPRLGLAPTGVGSSCPPAPASELARHLARRAPVSASPPVLPPIKDQGARPPTLAASAAAASSPPPPPPPPIPPLPPSTSTSAARPTDMAGVTSKRRSSSASTSSSSGDGAAVSDRPRGVTRKRRSGGRCPRPAASLRPAAPRPSSVNMLDLNRAILDSDHHTAGLRVILQKELRYSDVSQLGRIVLPKKEAEAYLPILTSKDGKKSLCMHDLQNAQLWTFKYRYWPNNKSRMYVLENTGDYVRTHDLQLGDSIVIYKDDENNRFVIGAKKAGDQQAATVPQVDEHISTLFPIFPIAQVDDYLSPMAPQVDISAFVPHADENHEIFDGILNSLPEIPVANVRYSDFFDPFDDGMDMANTLNANANQSASLHVTDDKSGHSLIPNPKSGPHM

SEQ ID NO: 1477 - protein, 230 aa, Oryza sativa; identical to SEQ ID NO: 1216

SEQ ID NO: 1478 - protein, 233 aa, Oryza sativa
MVRGRTELKRIENPTSRQVTFSKRRNGLLKKAFELSVLCDAEVALIVFSPRGRLYEFASAPSLQKTIDRYKAYTKDHVNNKTIQQDIQQVKDDTLGLAKKLEALDESRRKILGENLEGFSIEELRGLEMKLEKSLHKIRLKKTELLEQQIAKLKEKERTLLKDNENLRGKHRNLEAAALVANHMTTTTAPAAWPRDVPMTSSTAGAADAMDVETDLYIGLPGTERSSNRSETG

SEQ ID NO: 1479 - protein, 1172 aa, Oryza sativa
MASGSRATPTRSPSSARPAAPRHQHHHSQSSGGSTSRAGGGGGGGGGGGGGAAAAESVSKAVAQYTLDARLHAVFEQSGASGRSFDYTQSLRASPTPSSEQQIAAYLSRIQRGGHIQPFGCTLAVADDSSFRLLAYSENTADLLDLSPHHSVPSLDSSAVPPPVSLGADARLLFAPSSAVLLERAFAAREISLLNPLWIHSRVSSKPFYAILHRIDVGVVIDLEPARTEDPALSIAGAVQSQKLAVRAISRLQALPGGDVKLLCDTVVEYVRELTGYDRVMVYRFHEDEHGEVVAESRRNNLEPYIGLHYPATDIPQASRFLFRQNRVRMIADCHAAPVRVIQDPALTQPLCLVGSTLRSPHGCHAQYMANMGSIASLVMAVIISSGGDDDHNISRGSIPSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTEVQIKDIIEWLTMCHGDSTGLSTDSLADAGYPGAAALGDAVSGMAVAYITPSDYLFWFRSHTAKEIKWGGAKHHPEDKDDGQRMHPRSSFKAFLEVVKSRSLPWENAEMDAIHSLQLILRDSFRDSAEGTSNSKAIVNGQVQLGELELRGIDELSSVAREMVRLIETATVPIFAVDTDGCINGWNAKVAELTGLSVEEAMGKSLVNDLIFKESEETVNKLLSRALRGDEDKNVEIKLKTFGPEQSKGPIFVIVNACSSRDYTKNIVGVCFVGQDVTGQKVVMDKFINIQGDYKAIVHNPNPLIPPIFASDENTCCSEWNTAMEKLTGWSRGEVVGKLLVGEVFGNCCRLKGPDALTKFMIVLHNAIGGQDCEKFPFSFFDKNGKYVQALLTANTRSRMDGEAIGAFCFLQIASPELQQAFEIQRHHEKKCYARMKELAYIYQEIKNPLNGIRFTNSLLEMTDLKDDQRQFLETSTACEKQMSKIVKDASLQSIEDGSSLVLEKGEFSLGSVMNAVVSQVMIQLRERDLQLIRDIPDEIKEASAYGDQYRIQQVLCDFLLSMVRFAPAENGWVEIQVRPNIKQNSDGTDTMLFLFRFACPGEGLPPEIVQDMFSNSRWTTQEGIGLSICRKILKLMGGEVQYIRESERSFFHIVLELPQPQQAASRGTS

SEQ ID NO: 1480 - protein, 173 aa, Oryza sativa
MSRSVEPLVVGRVIGEVLDTFNPCMKMIVTYNSNKLVFNGHELYPSAVVSKPRVEVQGGDLRSFFTLVMTDPDVPGPSDPYLREHLHWIVTDIPGTTDASFGREVISYESPKPNIGIHRFIFVLFKQKRRQTVIVPSFRDHFNTRRFAEENDLGLPVAAVYFNAQRETAARRR

SEQ ID NO: 1481 - protein, 178 aa, Oryza sativa
MAGSGRDDPLVVGRIVGDVLDPFVRITNLSVSYGARIVSNGCELKPSMVTQQPRVVVGGNDMRTFYTLVMVDPDAPSPSNPNLREYLHWLVTDIPGTTGATFGQEVMCYESPRPTMGIHRLVFVLFQQLGRQTVYAPGWRQNFSTRNFAELYNLGSPVATVYFNCQREAGSGGRRVYP

SEQ ID NO: 1482 - protein, 289 aa, Oryza sativa
MAPAAASLTAPNALAATSLPFLHGRKSGGGGVSVHAGAPSPSRAVAVVARRLWGSASSSRRMVVAAATAAEMAPAASGEEGKPFVEEMRAVAMRLHTKDQAKEGEKEPQAPPVARWEPSVDGYLRFLVDSKLVFETLETIVDRAAVPWYAEFRNTGLERSEQLKKDLEWFKEQGHTIPEPSAPGTTYASYLEELAEKDSQAFICHFYNVYFAHTAGGRMIGKKVSENILNKKELEFYKWEGNLSQLLQNVRNKLNEVASSWTREEKDHCLDETEKSFSYSGDLLRHIFT

SEQ ID NO: 1483 - protein, 281 aa, Oryza sativa
MSGLYSPGFSPARNLSPQIRSNPTDVDSQYLAELLAEHQKLGPFMQVLPICSKLLSQEIMRVSSIVHNHGFGDFDRHRFRSPSPMSSPNPRSNRSGNGFSPWNGLHQERLGFPQGTSMDWQGAPPSPSSHVVKKILRLDVPVDSYPNFNFVGRILGPRGNSLKRVEASTGCRVFIRGKGSIKDPGKEDKLRGKPGYEHLSDPLHILIEAEFPASIIDARLRHAQEVIEELLKPVDESQDFYKRQQLRELAMLNSTLREDSPHPGSVSPFSNGGMKRAKTGQ

SEQ ID NO: 1484 - protein, 592 aa, Oryza sativa
MLYECYDIILVLERDSVMKKFQGVILQLEQALCDIPYNELDISDEVREQVELVHAQLKRAKERIDMPDDEFYNDLLSVYDKNYDPSAELAILGRLSEKLHLMTITDLTQESLALHEMVASGGGQDPGEHIERMSMLLKKIKDFVQTQNPDMGPPMASRVLDSNGDSRPITIPDEFRCPISLELMKDPVIVSTGQTYERACIEKWIASGHHTCPTTQQKMSTSALTPNYVLRSLISQWCETNGMEPPKRSTQPNKPTPACSSSERANIDALLSKLCSPDTEEQRSAAAELRLLAKRNANNRICIAEAGAIPLLLSLLSSSDLRTQEHAVTALLNLSIHEDNKASIISSGAVPSIVHVLKNGSMEARENAAATLFSLSVIDEYKVTIGGMGAIPALVVLLGEGSQRGKKDAAAALFNLCIYQGNKGRAIRAGLVPLIMGLVTNPTGALMDEAMAILSILSSHPEGKAAIGAAEPVPVLVEMIGSGTPRNRENAAAVMLHLCSGEHHLVHLARAQECGIMVPLRELALNGTDRGKRKAVQLLERMSRFLVQQQEEQESQSQASAQVPPQATPEQVPENDIPEQLDSPASQYPMVV

SEQ ID NO: 1485 - protein, 725 aa, Oryza sativa; identical to SEQ ID NO: 1246

SEQ ID NO: 1486 - protein, 885 aa, Oryza sativa
MVSRSYSNLLELAAGGGGGGGGEGPLPSLGRRRIPRVVTASGIVPDLDYSDDDAASAASSSDHSSAHSHAPRERAIIVANQLPIRASRRGGGGGGWEFSWDEDSLLLQLRDSLRAHADRADDMEFVYVGGLRDDVPAAEHDEVAHHLLEGFRCVPTFLPADLRSRFYHGFCKQQLWPLFHYMLPLSPELGGRFDRALWQAYVSVNKIFADKILEVISPDEDYVWVHDYHLMILPTFLRKRFNRVKLGFFLHSPFPSSEIYKTLPVREELLRSLLNADLIGFHTFDYARHFLSCCGRMLGLKYESQRGYIALEYYGRTVTIKILPVGVHLEQLRSVLNLPETGVKVAELLKQFCDQNRLMLLGVDDMDIFKGISLKLLAFEQLLMQHPEWRGRVVLVQIANPARGRGKDVKEVQDESYAMVRRINEAFGQPGYQPVILIDRPLQFYERMAYYVVAECCLVTAVRDGMNLIPYEYVIARQGNEKLDGILGLGPSARKKSMLVVSEFIGCSPSLSGAIRVNPWNIDAVADAMDSALEMPEGEKVLRHEKHHKYVSTHDVGYWANSFLQDLERTCLDHSRRRCWGIGFGLRFRVVALDPNFKKLAVEHLVSAYRRTTTRIILLDYDGTLMPQTSFGKSPSSKTIDMLNSLSRDQNNMVFLVSTKKRSTLEEWFSSCDNLGLAAEHGYFLRLKRDAEWETCVPVTDRSWKQIAEPVMKTYTETTDGSTIEDKETAIVWSYEDADPDFGSCQAKELHDHLESVLANEPVTVKAGLNHVEVKPQGVSKGLVAKRLLSIIRENSLLPDFVLCIGDDRSDEDMFEVITTAAQDNCLSPDAEVFACTVGRKPSKAKYYLDDLADIVRLIQGLANVSDEMHSTMPTPVDAADTALR

SEQ ID NO: 1487 - protein, 713 aa, Oryza sativa
MECENGRVSANGMSGLCVAAPRADPLNWGKATEEMTGSHLDEVKRMVAEYRQPLVKIEGASLRIAQVAAVAAAGEARVELDESARERVKASSDWVMNSMMNGTDSYGVTTGFGATSHRRTKEGGALQRELIRFLNAGAFGTGTDGHVLPAEATRAAMLVRINTLLQGYSGIRFEILEAIAKLLNANVTPCLPLRGTITASGDLVPLSYIAGLVTGRENAVAVAPDGSKVNAAEAFKIAGIQGGFFELQPKEGLAMVNGTAVGSGLASTVLFEANILAILAEVLSAVFCEVMNGKPEYTDHLTHKLKHHPGQIEAAAIMEHILEGSSYMKHAKKLGELDPLMKPKQDRYALRTSPQWLGPQIEVIRAATKSIEREINSVNDNPLIDVSRGKALHGGNFQGTPIGVSMDNTRLAIAAIGKLMFAQFSELVNDFYNNGLPSNLSGGRNPSLDYGFKGAEIAMASYCSELQFLGNPVTNHVQSAEQHNQDVNSLGLISSRKTDEAIDILKLMSSTFLIALCQAVDLRHIEENVKSAVKSCVMTVAKKTLSTNSTGDLHVARFCEKDLLKEIDREAVFAYADDPCSHNYPLMKKLRNVLVERALANGAAEFNADTSVFAKVAQFEEELRATLPGAIEAARAAVENGTAAIPSRITECRSYPLYRFVREELGTKYLTGEKTRSPGEELNKVLVAINEGKHIDPLLECLKEWNGEPLPIC

SEQ ID NO: 1488 - protein, 701 aa, Oryza sativa
MAGNGPINKEDPLNWGAAAAEMAGSHLDEVKRMVAQFREPLVKIQGATLRVGQVAAVAQAKDAAGVAVELDEEARPRVKASSEWILNCIAHGGDIYGVTTGFGGTSHRRTKDGPALQVELLRHLNAGIFGTGSDGHTLPSETVRAAMLVRINTLLQGYSGIRFEILEAITKLLNTGVTPCLPLRGTITASGDLVPLSYIAGLITGRPNAQAISPDGRKVDAAEAFKLAGIEGGFFTLNPKEGLAIVNGTSVGSALAATVMFDANILAVLSEVLSAVFCEVMNGKPEYTDHLTHKLKHHPGSIEAAAIMEHILAGSSFMSHAKKVNEMDPLLKPKQDRYALRTSPQWLGPQIEVIRAATKSIEREVNSVNDNPVIDVHRGKALHGGNFQGTPIGVSMDNARLAIANIGKLMFAQFSELVNEFYNNGLTSNLAGSRNPSLDYGFKGTEIAMASYCSELQYLANPITNHVQSAEQHNQDVNSLGLVSARKTLEAVDILKLMTSTYIVALCQAVDLRHLEENIKSSVKNCVTQVAKKVLTMNPTGDLSSARFSEKNLLTAIDREAVFSYADDPCSANYPLMQKLRAVLVEHALTSGDAEPEASVFSKITKFEEELRSALPREIEAARVAVANGTAPVANRIVESRSFPLYRFVREELGCVFLTGEKLKSPGEECNKVFLGISQGKLIDPMLDCLKEWNGEPLPIN

SEQ ID NO: 1489 - protein, 500 aa, Oryza sativa
MAMMAMGAASWAPIPAPARAAAAFYPGRDLAAARRRRGAAARRPFVFTPRAVSDSRSSQTCLDPDASTSVLGIILGGGAGTRLYPLTKKRAKPAVPLGANYRLIDIPVSNCLNSNVSKIYVLTQFNSASLNRHLSRAYGNNIGGYKNEGFVEVLAAQQSPENPNWFQGTADAVRQYLWLFEEHNVMEFLILAGDHLYRMDYQKFIQAHRETNADITVAALPMDEERATAFGLMKIDDEGRIIEFAEKPKGEKLKSMMVDTTILGLDTERAKELPYIASMGIYVFSKDVMLKLLRQNFPAANDFGSEVIPGATEIGMRVQAYLYDGYWEDIGTIEAFYNANLGITKKPVPDFSFYDRSAAIYTQPRYLPPSKVLDADVTDSVIGEGCVIRHCTINHSVVGLRSCISEGAVIEDSLLMGADYYETETDKKALSETGGIPIGIGKNAHIRKAIIDKNARIGENVKIINVDNIQEASRETDGYFIKSGIVTVIKDALIPSGTVI

SEQ ID NO: 1490 - protein, 329 aa, Oryza sativa; identical to SEQ ID NO: 1091

SEQ ID NO: 1491 - protein, 600 aa, Oryza sativa
MGVTKAEAVAGDGGKVVDDIEALADLRKEPAWKRFLSHIGPGFMVCLAYLDPGNMETDLQAGANHKYELLWVILIGLIFALIIQSLSANLGVVTGRHLAELCKTEYPVWVKTCLWLLAELAVIASDIPEVIGTGFAFNLLFHIPVWTGVLIAGSSTLLLLGLQRYGVRKLEVVVALLVFVMAGCFFVEMSIVKPPVNEVLQGLFIPRLSGPGATGDSIALLGALVMPHNLFLHSALVLSRNTPASAKGMKDVCRFFLFESGIALFVALLVNIAIISVSGTVCNATNLSPEDAVKCSDLTLDSSSFLLRNVLGKSSATVYGVALLASGQSSTITGTYAGQYVMQGFLDIKMKQWLRNLMTRSIAIVPSLIVSIIGGSSGAGRLIVIASVQSFTTNENISLPIRTLIKKNCHTINHLLIFSIISKLFANRNASFFKKWTVCNLLYLIPSDHTVKKNQNLMLVLVWLLRFIQMILSFELPFALIPLLKFSSSSNKMGENKNSIYIVGFSWVLGFVIIGINIYFLSTKLVGWILHNALPTFANVLIGIVLFPLMLLYVVAVIYLTFRKDTVKFVSRRELQAGDDTEKAQVATCVADEHSKEPPV

SEQ ID NO: 1492 - protein, 550 aa, Oryza sativa
MSGPMQRSSQPQFISSVERNNQSNGPGTPLIDSIDVDQIVIPEKNSWKNLFSYIGPGFLVSIAYIDPGNFETDLQAGAQYKYELLWIILIASCAALIIQSLAARLGVVTGKHLAEHCRAEYPKATNFILWILAELAVVACDIPEVIGTAFALNMLFKIPVWCGVLITGLSTLMLLLLQQYGVRKLEFLIAILVSLIATCFLVELGYSKPNSSEVVRGLFVPELKGNGATGLAISLLGAMVMPHNLFLHSALVLSRKVPRSVHGIKEACRFYMIESAFALTIAFLINISIISVSGAVCGSDNLSPEDQMNCSDLDLNKASFLLKNVLGNWSSKLFAVALLASGQSSTITGTYAGQYVMQGFLDLRMTPWIRNLLTRSLAILPSLIVSIIGGSSAAGQLIIIASMILSFELPFALVPLLKFTSSRTKMGQHTNSKAISVITWGIGSFIVVINTYFLITSFVKLLLHNGLSTVSQVFSGIFGFLGMLIYMAAILYLVFRKNRKATLPLLEGDSTVRIVGRDTATEGEGSLGHLPREDISSMQLPQQRTASDLD

SEQ ID NO: 1493 - protein, 343 aa, Oryza sativa
MTVEVEAVTMAKEEQPEEEEVIEKLVEKITGLAAAIGKLPSLSPSPEVNALFTELVMTCIPPSSVDVEQLGAEAQDMRGRLIRLCADAEGHLEAHYSDVLAAHDNPLDHLALFPYFNNYIQLAQLEYALLARHLPAAPPPSRLAFLGSGPLPLSSLVLAARHLPAASFHNYDICADANRRASRLVRADRDLSARMAFHTSDVAHVTTDLAAYDVVFLAALVGMAAEEKARMVEHLGKHMAPGAALVVRSAHGARGFLYPVVDPEEIRRGGFDVLAVHHPEGEVINSVIIARKPPVAAPALEGGDAHAHGHGAVVSRPCQRCEMEARAHQKMEDMSAMEKLPSS

SEQ ID NO: 1494 - protein, 733 aa, Oryza sativa
MRPTSRILAAGHLLRGSRSRYDPSPVAAAAPIFRRPPTVPRPLPSPLLGGFGPNCWVYPGDGKYAPFGRLSCFMSDSTYPPPPRDVRGHAFSTSANAVAVGKSSDDKVKKDISKKDVDDQIADTQILKNLGKYLLLNDSPDFRFRLILSLGLLVGAKVINVQVPFLFKLAVDWLAALAGAETSLASFTEANATLLALFASPAAVLIGYGIARSGVSACTELRNAVFSKVTLRAIRSVSSTVFSHLHELDLRYHLSRQTGALNRIIDRGSRAINYILTVMVFNVVPTILEIGMVSSILAYKFGSTFAWITSVSVATYIAFTLAVTQWRTKFRTAMNKADNASSTVAVDSLLNYETVKYFNNEQFEVEKYDKYLKKYEDAALKTQSSLAYLNFGQNIIFSSALSTAMVLSSYGVMSGALTVGDLVMVNGLLFQLSLPLNFLGSVYRESRQSLIDMKSMFQLLEEKPGIKDEPHAQPLQFKGGRIEFENVHFGYVPERKILKGATFTVPAGKSVAIVGTSGSGKSTILRLLFRFFDSSSGSIRIDGQDIREVTLDSLRKCIGVVPQDTVLFNDTIKHNIQYGRLSATDEEVYDVARRAAIHDTIMNFPDKYNTVVGERGLKLSGGEKQRVSIARVFLKEPSILLCDEATSALDSTTEASILNSLKTLSVDRTSIFIAHRLTTAMQCDEIIVLENGEVVEQGPHDFLLSKGGRYAELWSQQNNSDAIDAAAVSLEVS

SEQ ID NO: 1495 - protein, 418 aa, Oryza sativa
MDSHNSAPPQIAEVRMDISSSTSVAAGNKVCRGAACDFSDSSNSSKDARERMASMRKLIIAVILCIIFMAVEVVGGIKANSLAILTDAAHLLSDVAAFAISLFSLWAAGWEATPQQSYGFFRIEILGALVSIQLIWLLAGILVYEAIVRLINESGEVQGSLMFAVSAFGLFVNIIMAVLLGHDHGHGHGHGHGHGHSHDHDHGGSDHDHHHHEDQEHGHVHHHEDGHGNSITVNLHHHPGTGHHHHDAEEPLLKSDAGCDSTQSGAKDAKKARRNINVHSAYLHVLGDSIQSIGVMIGGAIIWYKPEWKIIDLICTLIFSVIVLFTTIKMLRNILEVLMESTPREIDATSLENGLRDMDGVVAVHELHIWAITVGKVLLACHVTITQDADADQMLDKVIGYIKSEYNISHVTIQIERE

SEQ ID NO: 1496 - protein, 258 aa, Oryza sativa; identical to SEQ ID NO: 1195

SEQ ID NO: 1497 - protein, 708 aa, Oryza sativa
MADPAGAGGEQEAPSVEAAFAGQPPPPWWQQVTVRAVAVSVVLGTLFSFMAMRTGLTAGFVPSFNMSASLLSFFIIKSWTRLMARCGVASQPFTRQENVVVQTCVISCATLSIYGGFTSYLLAMNETVAKAAGGGTDGRNVYTLHTGKIVAFLFLVTFSSLFCTLPLRNTMIVDYKLIYPSGSAVAGIVNSFHTPKGATKAKLQVNAMFKSVAGSFAWAFFQWFYTGGDGCGFHAFPLFGLEAYKEKFYFDFSASLVGVGMICPHLINFSMLLGSISSSGFIWPALQAKQGEWYTDPSPTSFKGINGYKVPMGVSMVLGDCLFQLGAITVKAVQHYRKGRQEQKLAVDGAADDGGGGCVPDDDDENKWHATYDERRRNQVFLSDGIPDQFAVAGYVALAALSTALVPRIFPQIRYHHVAVCYAVAPLLAFCNSYTSGLMDWSLATVYGKLAIFVVGASVGAASGGVIAGLAACGVMMVVIGDAAELMHDFKTAYLTLTSPVSMFASQAIGTALGCVVNPAVFLAFRWLAGAEHPPGDPRSAYAAPMAVAYRGIAVLGVEGVGTLPRHAIALCAACFAAAVFLDTAGAAARAARWRVGGWVPNPMAMAIPFFVGPTFAIDMCVGSLLLMAWRRADRQGAATLAVVVASGLICGEGLWTLPSAVLAMLKVQPPICMKFLSRSQIQEVRQHFVLGAADIQPAVTLTHHHHQ

SEQ ID NO: 1498 - protein, 682 aa, Oryza sativa
MEAAAPEIERCDAGDVESDHDGAAAAAERVPPWREQVTARGMVAALLIGFVYTVIIMKLALTTGIIPTLNVSAALLAFLALRGWTRAPALLLPGGGAASSSSRRRPFTRQENTVVQTCAVACYTMGFGGARPATTSCGFGSSLLALNRKTYELAGVSTPGNSPGSYKEPGVGWMTGFLFAISFVGLLNLLPLRKALIIDYKLTYPSGTATAVLINGFHTPQGENSAKKQVRGFLNCFGISLLWSFFQWFYTGGESCGFLQFPTFGLKAWKQTFYFDFSLTYVGAGMICSHLVNLSALFGAILSWGIMWPLISIQKGKWYPGNVPESSMTSLFGYKSFMCVALIMGDGLYHFIKVTGITAKSLHERSNRRHAKKATDEDTFVIADMQRDEFFNKDYIPNWLAYAGYALLSIVAVIAIPIMFQQVKWYYVVVAFVLAPVLGFSNAYGTGLTDMNMSYNYGKIALFIFAAWGGRDNGVIAGLVGCGIVKQLVQVSADLMHDFKTGHLTLTSPRSMLVGQAIGTAMGCIIAPLTFLLFYKAFDIGNPDGYWKAPYALIFRNMAILGVEGFSALPKHCLELSAGFFAFSVLINLMRDFLPRKYRDYVPLPTAMAVPFLVGANFAIDMCVGSLIVFAWHKINSKESALLVPAVASGFICGDGIWMFPSSLLSLAKVKPPICMKFTPGS

SEQ ID NO: 1499 - protein, 326 aa, Oryza sativa
MEAQNQEVAALVEKIAGLHAAISKLPSLSPSAEVDALFTDLVTACVPASPVDVAKLGPEAQAMREELIRLCSAAEGHLEAHYADMLAAFDNPLDHLARFPYYGNYVNLSKLEYDLLVRYVPGIAPTRVAFVGSGPLPFSSLVLAAHHLPDAVFDNYDRCGAANERARRLFRGADEGLGARMAFHTADVATLTGELGAYDVVFLAALVGMAAEEKAGVIAHLGAHMADGAALVVRSAHGARGFLYPIVDLEDIRRGGFDVLAVYHPDDEVINSVIVARKADPRRGGGLAGARGAVPVVSPPCKCCKMEAAAGAFQKAEEFAAKRLSV

SEQ ID NO: 1500 - protein, 362 aa, Oryza sativa
MGQMDGGDGGGGGHPYHYQALLAAVHQQTVPFPNPFPAPSSGAEPPHPHNHNHNHNHNHNIHNSHNHNHNHNAAPHPCHTPTPTPTPRGFADWSASTSAFTSLAAHSSTAPSNAVHYSFSPCYAFWTHYMLNKNAYPTSFPAPHDDHLRLANNNHPRDAPGPASSYGVESFTSPSMAPNICTHMPPIEGPISAKEDKKPEILPRVVKSSDELETRNSNVEFHSETVGTLPESKQGHDSRATKLLNSGEYQVILRKELTKSDVGNVGRIVLPKKDAEASLPPLLQRDPLILHMDDMVLPVTWKFKYRYWPNNKSRMYILDSAGEFLKTHGLQAGDVIIIYKNLAPGKFIIRGEKAIHQQTTNP

SEQ ID NO: 1501 - protein, 449 aa, Oryza sativa
MAQTCLPPGFRFHPTDVELVSYYLKRKIMGKKPLIQAISDVELYKFAPWDLPAQSCLQSRDLEWFFFCPRDKKYPNGSRTNRSTPNGYWKTSGKDRTIELNSRIVGSKKTLIFHEGKAPKGNRTDWVMYEYKMEDNQLVSAGFSKDDFVLCKIFKKSGLGPRIGEQYGAPFNEEEWEHADAEMFPLLPNVETSVFPLLPSSEVVNSTDDTRVQPSVAARAIEELPVQHLPHVCAGNGSTYQNITVTGESALMELPSQHSVESIGDEVVSVDNCSNVVNNADSPVIEGLVLEELSRFLTDSPHHGNPVGEHSGLPPMSEAEAHAFEVSTNDLYNEIAGLAELGVPNGDGFSPSNAGVTEQQPTYFGVPNSENYVNMDDIFAPDTRLSYAYPLPNNQFWHYPMDQFTYSTTLSAAFPSGDSRPTMRIVDDLPAAANNGGFASKPSMQFPLS

SEQ ID NO: 1502 - protein, 550 aa, Oryza sativa
MEEGAKIGREHEQQQQQHGRVNGSGRVAAVGGGSGGGGDEIEIEVAAAAGASPSRQHGGLHGDVQAPTWKRFLAHVGPGFVISIAYLDPSNLQTDLVAGSSHRYSLLWVLLFGFIFVLTVQSLAANLGIITGRHLAELCMGEYPKYVKYCLWLLAELGVIAATIPGVLGTALAYNMLLHIPFWAGVLACGACTFLILGLQGYGARKMEFTISVLMLVMATCFFMELGKVNPPAGGVIEGLFIPRPKGDYSTSDAVAMFGSLVVPHNLFLHSSLVLTRKMPYTSKGRKDASTFFLLENALALFIALLVNVAIVSISGTICANNLSFADTSTCSSLTLNSTYVLLKNILGKSSSTVYGVALLVSGQSCMVATSYAGQYIMQGFSGMRKCIIYLVAPCFTLLPSLIICSIGGTLRVHRIINIAAIVLSFVLPFALIPLIKFSSSCTNIGPYKNATSIIRIAWILSLVIIGINIYFFCTSFVAWLVHSDLPRVVNAIISSLVFPFMAAYIAALIYLAFRKVNLSDPFPTNSVSGEIEVQHIQIQEKQEDLGVHL

SEQ ID NO: 1503 - protein, 248 aa, Oryza sativa
MEQLFVDDPAFASSMSSLEADIFSGAGQLPSSPWLDLDLDDDVQDLSMAPTTANAVSSGYGSGGSGSHRKLSHNAYERDRRKQLNELYSSLRALLPDADHTKKLSIPTTVSRVLKYIPELQKQVENLERKKKELTTTSTTNCKPGVLGSQLMSEGMAPIVSATCINDMEIMVQVSLLSNVAGSVLPLSKCIKVLENEGLHFISSSTSSGFGNRTFYSIHLQRSEGTINEECPAFCERLEKVVRNKAKL

SEQ ID NO: 1504 - protein, 252 aa, Oryza sativa
MVPSERGDVATAIRPAAADKLVHGPISDKKCRKKVPRKVHKSEREKLKRGHLNDLFGELGNMLEADRQSNGKACILTDTTRILRDLLSQVKSLRQENSTLQNESNYVTMERNELQDENGALRSEISDLQNELRMRATGSPGWGHGATGSPLPVPPSPGTVFPSQQPMQPSPMTTSTVFPLQQPLPQPTVIEPSARQPLELKLFLEAPPAEDPEPSEDQEAPNNVARPQPRYPTEASSWPISLGLPRMEDEQM

SEQ ID NO: 1505 - protein, 672 aa, Oryza sativa
MEHADADRTRVAPEIGSLHDEDAEADPARAREMERLQPWREQVTARGVVAAALIGFVFSVIVMKIALTTGLVPTLNISAALLAFLALRGWTRALERLGFSPRPFTRQENTVVQTCAVACYTIAFGGGFGSTLLGLNKRTYELAGNSPGNVPGSYKEPGIGWMVGLLLAISFAGNLSLIPLRKALVVDYKLTYPSGTATAVLINGFHTAQGDKNAKLQLHGFLKYFGLSLFWSFFQWFYTGGNACGFVQFPTFGLKAWKQSFFFDFSLTYVGAGMICSHLVNLSTLLGAVISWGIMWPLISKHKGDWYPANIPESSMTSLYGYKSFLCIALIMGDGLYHFVKVTGVTAKSLHNRFNRKSVSNTASEEGDMVSLDDLQRDEVFKRGTVPSWMAYSGYFLLSIIAVITIPIMFRQVKWYYVIIAYALGPVLGFANSYGAGLTDINMGYNYGKIALFVFAAWAGKDNGVIAGLVVGTLVKQLVLVSADLMHDLKTGHLTLTSPRSMLVGELIGTGIGCFIAPLTFMLFYRAFDIGNPDGYWKAPYALIYRNMAILGIEGISALPKHCLSLSVGFFAFAVLTNVARDALPARYKKLVPLPTAMAVPFLVGASFAIDMCVGSLVLFAWNKMNKKEAAFMVPAVASGLMCGDGIWTFPSSILALAKIKPPICMKFTPGS

SEQ ID NO: 1506 - protein, 318 aa, Oryza sativa
MSDGGAGAKGAGFGMPRVGMGTAVQGPRPEPIRRAVLKAIEAGYRHFDTAAHYETEAPIGEAAAEAVRSGAIASRADLFITSKLWCSDAHRDRVLPALRQTLWNLQMEYVDLYLVHWPVSMKPGRYKAPFTADDFVPFDMRAVWEAMEECHRLGLAKAIGVCNFSCKKLDTLLSFATIPPAVNQVEVNPVWQQRKLRELCREKGVQICAYSPLGASGTHWGSDSVMASAVLRDIAQSKGKTVAQVCLRWVYEQGDCLIVKSFDEARMRENLDIVGWELTEEERQRIAGIPQRKINRALRFVSDHGPYKSLDDLWDGEI

SEQ ID NO: 1507 - protein, 494 aa, Oryza sativa
MHASCCCAPPESVSHTRRISYKYSGTSYPTRTTTTSSSAPEFTNKKQSTAMAPTTAAAAASSNGGGESDGSSKEWRLTAPTRGGAMAAAGDKMSIRAVRYKISASVDDRGPRPVLPLAHGDPSVFPEFRTAAEAEDAVADALRSGDFNCYPAGVGLPAARRAVADHLSRDLPYKLSSDDIFLTAGGTQAIEVVISILAQPGTNILLPRPGYPNYEARAAFNNLEVRHFDLIPEKGWEIDLNSLESIADKNTTAIVIINPNNPCGNVYTYEHLSKVAEVARKLGILVITDEVYGNLVFGSSPFVPMGCFGHIVPILTIGSLSKRWIVPGWRLGWVAICDPKKTLQETKIATLITNFLNVSTDPATFIQGALPNILKNTKEEFFKRIIDLLTETSDICYRGIKDIKCITCPHKPEGSMFVMVKLNLYLLEGIHDDVDFCCQLAKEESVILCPGSVLGMKNWVRITFAIDSSSLLDGLERIKSFCQRHKKKNPLNYI

SEQ ID NO: 1508 - protein, 510 aa, Oryza sativa; identical to SEQ ID NO: 1117

SEQ ID NO: 1509 - protein, 714 aa, Oryza sativa; identical to SEQ ID NO: 1329

SEQ ID NO: 1510 - protein, 1505 aa, Oryza sativa
MPHFPNLPLPEAAAAAAHAALLALALLLLLLRSARALASRCASCLKTAPRRAAAVDGGLAAASSVGAWYRAALACCGYALLAQVAALSYEVAVAGSHVAVEALLLPAVQALAWAALLALAMQARAVGWGRFPVLVRVWWVVSFVLCVGIAYDDTRHLMGDDDDDEVDYAHMVANFASAPALGFLCLVGVMGSTGVELEFTDDDSSVHEPLLLGGQRRDADEEPGCLRVTPYGDAGIVSLATLSWLSPLLSVGAQRPLELADIPLMAHKDRAKSCYKAMSSHYERQRMERPGSEPSLAWAILKSFWREAAINGAFAAVNTIVSYVGPYLISYFVDYLSGKIEFPHEGYILASVFFVAKLLETLTARQWYLGVDVMGIHVKSGLTAMVYRKGLRLSNSSRQSHTSGEIVNYMAVDVQRVGDYAWYFHDIWMLPLQIILALAILYKNVGIAMVSTLVATVLSIAASVPVAKLQEHYQDKLMASKDERMRKTSECLKNMRILKLQAWEDRYRLKLEEMRNVECKWLRWALYSQAAVTFVFWSSPIFVAVITFGTCILLGGELTAGGVLSALATFRILQEPLRNFPDLISMIAQTRVSLDRLSHFLQQEELPDDATITVPHGSTDKAININDATFSWNPSSPTPTLSGINLSVVRGMRVAVCGVIGSGKSSLLSSILGEIPKLCGQVRISGSAAYVPQTAWIQSGNIEENILFGSPMDKQRYKRVIEACSLKKDLQLLQYGDQTIIGDRGINLSGGQKQRVQLARALYQDADIYLLDDPFSAVDAHTGSELFREYILTALASKTVIYVTHQIEFLPAADLILVLKDGHITQAGKYDDLLQAGTDFNALVCAHKEAIETMEFSEDSDEDTVSSVPIKRLTPSVSNIDNLKNKVSNNEKPSSTRGIKEKKKKPEERKKKRSVQEEERERGRVSLQVYLSYMGEAYKGTLIPLIILAQTMFQVLQIASNWWMAWANPQTEGDAPKTDSVVLLVVYMSLAFGSSLFVFVRSLLVATFGLATAQKLFVKMLRCVFRAPMSFFDTTPSGRILNRVSVDQSVVDLDIAFRLGGFASTTIQLLGIVAVMSKVTWQVLILIVPMAVACMWMQRYYIASSRELTRILSVQKSPVIHLFSESIAGAATIRGFGQEKRFMKRNLYLLDCFARPLFSSLAAIEWLCLRMELLSTFVFAFCMAILVSFPPGTIEPSMAGLAVTYGLNLNARMSRWILSFCKLENRIISVERIYQYCKLPSEAPLIIENSRPSSSWPENGNIELVDLKVRYKDDLPLVLHGISCIFPGGKKIGIVGRTGSGKSTLIQALFRLIEPTGGKVIIDDVDISRIGLHDLRSRLSIIPQDPTLFEGTIRMNLDPLEECTDQEIWEALEKCQLGEVIRSKDEKLDSPVLENGDNWSVGQRQLIALGRALLKQAKILVLDEATASVDTATDNLIQKIIRSEFKDCTVCTIAHRIPTVIDSDLVLVLSDGKIAEFDTPQRLLEDKSSMFMQLVSEYSTRSSCI

SEQ ID NO: 1511 - protein, 661 aa, Oryza sativa
MVGMRGAYGYNDNGNEGGVVVGGGEAEAEIAAMAVLHKVAAPPAQSTASKLKARVKETFFPDDPFRGFKGKPLTTKWVMAVQYLFPILDWVPSYSFSLFKSDLVAGLTIASLAIPQGISYAKLASLPPIIGLYSSFVPPMVYAVLGSSRDLAVGPVSIASLIMGSMLRQAVSPAAEPLLFLQLAFTSTFFAGLVQASLGILRLGFIIDFLSKATLVGFMAGAAIIVSLQQLKALLGIVHFTTEMGLVPVMASVIHHTKEWSWQTILMAVCFLVLLLTARHVSMKWPKLFWVSACAPLACVIVSTLLVFLFKAQKHGISIIGQLKCGLNRPSWDKLLFDPQYLGLTVKTGLVTGIISLTEGVAVGRTFASLKDYQVDGNKEMMAIGLMNIVGSCTSCYVTTGAFSRSAVNHNAGCKTAMSNVIMALTVMVTLLFLMPLFVYTPNVVLGAIIIAAVIGLIDLPAVYNIWKMDKMDFLVCLCAFAGVIFISVQQGLAIAVGISIFRVLLQITRPKMMIQGNIKGTDIYRNLHQYKDAQRVPGFLILTVEAPINFANTNYLNERIKRWIEEESSAGTKQSELHFVILDLSAVPAIDTSGISFLIDLKKSTEKHGLELILVNPTGEVMEKIQRANDAHGHFKSDSLYLTTGEAVASLSTFSKMTAP

SEQ ID NO: 1512 - protein, 510 aa, Oryza sativa; identical to SEQ ID NO: 1117

SEQ ID NO: 1513 - protein, 1615 aa, Oryza sativa
MATLPRAAAAAAPSPAAALLPLPRAAPLLAGRAAARSAARRLRARGTRAPPLAAARRGWGGVSPRAVLDLPRRREAAEKPAQKAADLNEILSERGACGVGFVANLKNEPSFNIVRDALVALGCMEHRGGCGADNDSGDGSGLMSGIPWDLFNDWANKQGLAPLDRTNTGVGMVFLPQDENSMEEAKAVVAKVFTDEGLEVLGWRTVPFNVSVVGRYAKETMPNIQQIFVKVAKEDNADDIERELYICRKLIERATKSASWADELYFCSLSSRTIVYKGMLRSEILGQFYLDLQNELYKSPFAIYHRRYSTNTSPRWPLAQPMRLLGHNGEINTIQGNLNWMRSREATLQSPVWRGREHEIRPFGDPKASDSANLDSTAELLLRSGRSPAEAMMILVPEAYKNHPTLSIKYPEVIDFYDYYKGQMEAWDGPALLLFSDGRTVGACLDRNGLRPARYWRTSDDFVYVASEVGVIPMDESKVVMKGRLGPGMMITVDLQTGQVLENTEVKKSVASANPYGSWLQQSTRSIKPVNFQSSVAMDNETVLRHQQAFGYSSEDVQMVIETMASQGKEPTFCMGDDIPLAVLSQKPHMLFDYFKQRFAQVTNPAIDPLREGLVMSLEVNIGKRRNILEVGPENADQVTLSSPVLNEGELESLLNDSKLKPKVLSTYFDIRKGLDGSLDKAIKVLCDEADAAVRNGSQLLVLSDRSEALEPTRPAIPILLAVGAIHQHLIQNGLRMSASIVADTAQCFSTHQFACLIGYGASAICPYLALETCRQWRLSNKTVNLMRNGKMPTVTIEQAQRNFIKAVKSGLLKILSKMGISLLSSYCGAQIFEIYGLGQEVVDLAFCGSVSKIGGLTLDELGRETLSFWVKAFSEDTAKRLENFGFIQSRPGGEYHANNPEMSKLLHKAVREKSDNAYTVYQQHLASRPVNVLRDLLELKSDRAPIPIGKVEPATSIVERFCTGGMSLGAISRETHEAIAIAMNRIGGKSNSGEGGEDPIRWSPLADVEDGYSPTLPHLKGLQNGDTATSAIKQVASGRFGVTPTFLVNAEQIEIKIAQGAKPGEGGQLPGKKVSAYIARLRNSKPGVPLISPPPHHDIYSIEDLAQLIYDLHQINPKAKVSVKLVAEAGIGTVASGVSKGNADIIQISGHDGGTGASPISSIKHAGGPWELGLSETHQTLIQNGLRERVVLRVDGGFRSGLDVLMAAAMGADEYGFGSVAMIATGCVMARICHTNNCPVGVASQREELRARFPGVPGDLVNYFLFVAEEVRATLAQLGFEKLDDIIGRTDILKAKHVSLAKTQHIDLKYLLSSAGLPKWSSSQIRSQDVHSNGPVLDETILADPDISDAIENEKEVSKTFQIYNVDRAVCGRVAGVIAKKYGDTGFAGQLNITFTGSAGQSFGCFLTPGMNIRLVGEANDYVGKGMAGGELVVVPVEKTGFVPEDAAIVGNTCLYGATGGQVFVRGKTGERFAVRNSLGQAVVEGTGDHCCEYMTGGCVVVLGKVGRNVAAGMTGGLAYILDEDDTLVPKVNKEIVKMQRVNAPAGQMQLKGLIEAYVEKTGSEKGATILREWEAYLPLFWQLVPPSEEDSPEACAEFERVLAKQATTVQSAK

SEQ ID NO: 1514 - protein, 483 aa, Oryza sativa
MAAPSVAVDNLNPKVLNCEYAVRGEIVIHAQRLQQQLQTQPGSLPFDEILYCNIGNPQSLGQKPVTFFREVIALCDHPCLLEKEETKSLFSADAISRATTILASIPGRATGAYSHSQGIKGLRDAIAAGIASRDGYPANADDIFLTDGASPGVHMMMQLLIRNEKDGILCPIPQYPLYSASIALHGGALVPYYLNESTGWGLEISDLKKQLEDSRLKGIDVRALVVINPGNPTGQVLAEENQRDIVKFCKNEGLVLLADEVYQENIYVDNKKFNSFKKIARSMGYNEDDLPLVSFQSVSKGYYGECGKRGGYMEITGFSAPVREQIYKVASVNLCSNITGQILASLVMNPPKAGDASYASYKAEKDGILQSLARRAKALENAFNSLEGITCNKTEGAMYLFPQLSLPQKAIDAAKAANKAPDAFYALRLLEATGIVVVPGSGFGQVPGTWHIRCTILPQEEKIPAIISRFKAFHEGFMAAYRD

SEQ ID NO: 1515 - protein, 498 aa, Oryza sativa
MATCAADLAPLLGPVAANATDYLCNRFADTTSAVDATYLLFSAYLVFAMQLGFAMLCAGSVRAKNTMNIMLTNVLDAAAGALFYYLFGFAFAFGTPSNGFIGKQFFGLKHMPQTGFDYDFFLFQWAFAIAAAGITSGSIAERTQFVAYLIYSAFLTGFVYPVVSHWIWSADGWASASRTSGPLLFGSGVIDFAGSGVVHMVGGVAGLWGALIEGPRIGRFDHAGRSVALKGHSASLVVLGTFLLWFGWYGFNPGSFTTILKTYGPAGGINGQWSGVGRTAVTTTLAGSVAALTTLFGKRLQTGHWNVVDVCNGLLGGFAAITAGCSVVDPWAAIICGFVSAWVLIGLNALAARLKFDDPLEAAQLHGGCGAWGILFTALFARQKYVEEIYGAGRPYGLFMGGGGKLLAAHVIQILVIFGWVSCTMGPLFYGLKKLGLLRISAEDETSGMDLTRHGGFAYVYHDEDEHDKSGVGGFMLRSAQTRVEPAAAAASNSNNQV

SEQ ID NO: 1516 - protein, 496 aa, Oryza sativa
MATCADTLGPLLGTAAANATDYLCNQFADTTSAVDSTYLLFSAYLVFAMQLGFAMLCAGSVRAKNTMNIMLTNVLDAAAGALFYYLFGFAFAFGAPSNGFIGKHFFGLKQVPQVGFDYSFFLFQWAFAIAAAGITSGSIAERTQFVAYLIYSAFLTGFVYPVVSHWIWSADGWASASRTSGSLLFGSGVIDFAGSGVVHMVGGVAGLWGALIEGPRIGRFDHAGRSVALRGHSASLVVLGSFLLWFGWYGFNPGSFLTILKSYGPPGSIHGQWSAVGRTAVTTTLAGSTAALTTLFGKRLQTGHWNVIDVCNGLLGGFAAITAGCSVVDPWAAIICGFVSAWVLIGLNALAARLKFDDPLEAAQLHGGCGAWGVIFTALFARKEYVDQIFGQPGRPYGLFMGGGGRLLGAHIVVILVIAAWVSFTMAPLFLVLNKLGLLRISAEDEMAGMDQTRHGGFAYAYHDDDASGKPDRSVGGFMLKSAHGTQVAAEMGGHV

SEQ ID NO: 1517 - protein, 498 aa, Oryza sativa
MATCLDSLGPLLGGAANSTDAANYICNRFTDTSSAVDATYLLFSAYLVFAMQLGFAMLCAGSVRAKNSMNIMLTNVLDAAAGALFYYLFGFAFAFGTPSKGFIGKQFFGLKHMPQTGYDYDFFLFQWAFAIAAAGITSGSIAERTRFSAYLIYSAFLTGFVYPVVSHWFWSTDGWASAGRLTGPLLFKSGVIDFAGSGVVHLVGGIAGLWGAFIEGPRIGRFDAAGRTVAMKGHSASLVVLGTFLLWFGWFGFNPGSFTTISKIYGESGTIDGQWSAVGRTAVTTSLAGSVAALTTLYGKRWLTGHWNVTDVCNGLLGGFAAITAGCSVVDPWASVICGFVSAWVLIGCNKLSLILKFDDPLEATQLHAGCGAWGIIFTALFARREYVELIYGVPGRPYGLFMGGGGRLLAAHIVQILVIVGWVSATMGTLFYVLHRFGLLRVSPATEMEGMDPTCHGGFGYVDEDEGERRVRAKSAAETARVEPRKSPEQAAAGQFV

SEQ ID NO: 1518 - protein, 147 aa, Oryza sativa
MYQAIPYSSTRPWLRPEPAASVVDVVKVETTTAVAGRGGEAEVVGEEEAAEVRRAVAESPVLVVGRRGCCLIHVVKRLLQGLGVNPAVHEVAGEAALKGVVPAGGEAAALPAVFVGGKLLGGLDRLMAVHISGELVPILKKAGALWL

SEQ ID NO: 1519 - protein, 357 aa, Oryza sativa
MANLTDLVNLNLSDCSDKIIAEYIWVGGSGIDLRSKARTVKGPITDVSQLPKWNYDGSSTGQAPGEDSEVILYPQAIFKDPFRRGDNILVMCDCYTPQGEPIPTNKRHSAAKIFSHPDVVAEVPWYGIEQEYTLLQKDVNWPLGWPVGGFPGPQGPYYCAAGAEKAFGRDIVDAHYKACIYAGINISGINGEVMPGQWEFQVGPSVGIAAADQVWVARYILERVTEVAGVVLSLDPKPIPGDWNGAGAHTNFSTKSMREPGGYEVIKKAIDKLALRHKEHIAAYGEGNERRLTGRHETADINTFKWGVANRGASIRVGRDTEKEGKGYFEDRRPASNMDPYVVTGMIAETTLLWKQN

SEQ ID NO: 1520 - protein, 428 aa, Oryza sativa; identical to SEQ ID NO: 953

SEQ ID NO: 1521 - protein, 2167 aa, Oryza sativa
MSAAQGMAYKLRTDAAPTGAGRRARRSHSSVAAPYRAARLVQGGVSIEGGLVGGCQLTEERVAARPPRAAARDAEPVRPLSTLPESSIGLYDPSRERDSCGVGFVAELSGDYKRATVNDALEMLERMAHRGACGCEKNTGDGAGILVALPHNFFREVTKDAGFELPQPGEYAVGMVFLPIDEKRRERSKAEFQKVAESLGHVILGWRRVPTDNSDLGESALQTEPVIEQVFLTKSSSSEADFEQQLYILRRLSILSIRAALNLRRGGKRDFYMCSLSSRTIVYKGQLKPCQLKGYYYADLGHENFTSYMALVHSRFSTNTFPSWDRAQPMRVLGHNGEINTLKGNKNWMKAREGLLECEKLGLTKDQFSKILPIVDATSSDSGAFDGVLELLIRGGRSLPEAVMMMIPEAWQNDVNMEPEKKALYEFLSALMEPWDGPALISFTDGRYLGATLDRNGLRPGRFYVTHSGRVVMGSEVGVVDVPSKDVLRKGRLNPGMMLLVDFENHTVVDDEALKAQYSKAHPYGEWLKRQKIYLKDIVESVPETERVAPGISGSLTQKNEKKEHAGVNGIVTPLKAFGYTVEALEMLLLPMAKDGVEALGSMGNDTPLAVMSNREKLTFEYFKQMFAQVTNPPIDPIREKIVTSMECMIGPEGDLLETTEKQCNRLALEGPLVSIDEMEAIKKMNYRGWRSKVLDITYPKKSGRKGLEETLDRICTEARGAIKKGYTVLVLSDRGFSSDRVAVSSLLAVGAVHQHLVANLERTRVGLLVESAEPREVHHFCTLVGFGADAVCPYLAIEAIWCLQNDGKIPPNGDGKPYSKEELVKKYFYASNYGMMKVLAKMGISTLASYKGAQIFEALGLSSEVIRKCFDGTPSRIEGATFEMLARDALRLHELAFPSRAPPPGSADAKALPNPGDYHWRKNGEVHLNDPLAMAKLQEAARVNSRAAYKEYSRRIQELNKTCNLRGMLKFKDTADMISVDEVEPASEIVKRFVTGAMSYGSISLEAHTALAMAMNKLGGKSNTGEGGEQPSRMEPLANGSMNPKRSAIKQVASGRFGVSSYYLTNADELQIKMAQGAKPGEGGELPGHKVIGDIAVTRHSTAGVGLISPPPHHDIYSIEDLAQLIHDLKNSNPRARISVKLVSEAGVGVVASGVVKGHADHVLISGHDGGTGASRWTGIKNAGLPWELGLAETHQTLVANGLRGRAILQTDGQLKTGKDVAVACLLGAEEFGFSTAPLITLGCIMMRKCHTNTCPVGIATQDPVLREKFAGEPEHVINFFFMLAEELREIMSQLGFRTITEMVGRSDMLEVDPEVVKSNEKLENIDLSLILKPAAEIRPGAAQYCVEKQDHGLDMALDNKLIALSKAALEKEVRVFIETPIQNTNRAVGTMLSHEVTKRYHMKGLPAGTIHVKLTGSAGQSLGAFLCPGITLELEGDSNDYVGKGLSGGKIVVYPPRDSTFIPEDNIVIGNVALYGATIGEAYFNGMAAERFCVRNSGAQAVVEGIGDHGCEYMTGGTVVILGKTGRNFAAGMSGGIAYVYDIDGKFSVRCNHELVDLYHVEEEEDITTLKMMIEQHRLNTGSVVARDILSNFDTLLPKFVKVFPRDYKRVLDNMKAEKAAAKLAKEPKISNGVSVTTKKVQPEQSTNRPTRVSNAKKYRGFISYERESISYRDPNERVKDWKEVAIESVPGPLLNTQSARCMDCGTPFCHQESSGAGCPLGNKIPEFNELVHQNRWREALDRLLETNNFPEFTGRVCPAPCEGSCVLGIIENPVSIKSIECAIIDKGFEEGWMVPRPPLQRTGKKVAIIGSGPAGLAAADQLNKMGHFVTVFERADRIGGLMMYGVPNMKTDKIEIVQRRVNLMAEEGITFVVNANVGSDPLYSIERLRSENDAVILACGATKPRDLGIPGRELSGVHFAMEFLHANTKSLLDSNLEDGRYISAKGKKVVVIGGGDTGTDCIGTSIRHGCTSIVNLELLTKPPSKRAADNPWPQWPRIFRVDYGHQEASSKFGNDPRTYEVLTKRFIGDENGNVKALEVVRVKWEKVDGRFQFKEIEGSNETIEADLVLLAMGFLGPEATIAEKLGLEKDNRSNFKAQFGNFATSVDGIFAAGDCRRGQSLVVWAITEGRQAAAAVDKYLSRNEQDAAEDITPSGAGFVQPVAA

SEQ ID NO: 1522 - protein, 498 aa, Oryza sativa
MSGDAFNMSVAYQPSGMAVPEWLNKGDNAWQMISATLVGMQSVPGLVILYGSIVKKKWAVNSAFMALYAFAAVWLCWVTWGYNMSFGHKLLPFWGKARPALGQSFLLAQAVLPQTTQFYKGGGGADAVVETPWVNPLYPMATMVYFQCVFAAITLILLAGSLLGRMNIKAWMLFVPLWLTFSYTVGAFSLWGGGFLFHWGVMDYSGGYVIHLSSGVAGFTAAYWVGPRSTKDRERFPPNNVLLMLTGAGILWMGWAGFNGGDPYSANIDSSLAVLNTNICAATSLLVWTCLDVIFFKKPSVIGAVQGMITGLVCITPGAGLVQGWAAIVMGILSGSIPWFTMMVVHKRSRLLQQVDDTLGVFHTHAVAGFLGGATTGLFAEPVLCSLFLPVTNSRGAFYPGRGGGLQFVRQVAGALFIICWNVVVTSLVCLAVRAVVPLRMPEEELAIGDDAVHGEEAYALWGDGEKYDSTKHGWYSDNNDTHHNNNKAAPSGVTQNV

SEQ ID NO: 1523 - protein, 340 aa, Oryza sativa
MGGVAAGTRWIHHVRRLSAAKVSADALERGQSRVIDASLTLIRERAKLKAELLRALGGVKASACLLGVPLGHNSSFLQGPAFAPPRIREAIWCGSTNSSTEEGKELNDPRVLTDVGDVPIQEIRDCGVEDDRLMNVVSESVKTVMEEDPLRPLVLGGDHSISYPVVRAVSEKLGGPVDILHLDAHPDIYDAFEGNIYSHASSFARIMEGGYARRLLQVGIRSITKEGREQGKRFGVEQYEMRTFSKDREKLESLKLGEGVKGVYISVDVDCLDPAFAPGVSHIEPGGLSFRDVLNILHNLQGDVVAGDVVEFNPQRDTVDGMTAMVAAKLVRELTAKISK

SEQ ID NO: 1524 - protein, 116 aa, Oryza sativa
MSTTVTRAHLEQRLALAKRCSREANLAGVKAAAVATIASAVPTLASVRMLPWAKANINPTGQALIICTAAGMAYFVAADKKILSLARRHSFENAPEHLKNTSFQGTGRPHPAFFRP

SEQ ID NO: 1525 - protein, 2188 aa, Oryza sativa
MSAAQGLALKLRAAPAAGGVRGEKRRRAASATAAAAARPRHGAMSLEGGFLGGALPAEDRVAPRASASRQAEAGAGAGAARPPPRSMSKIPESSIGLYDPSMERDSCGVGFIAELSGEYSRKTVDDAIEMLDRMAHRGACGCEKNTGDGAGILVALPHNFFREVTKDAGFELPPPGEYAVGMFFMPTDDKRREKSKLLFREKAELLGHTVLGWRRVPTDNSGLGQSAVDTEPVIEQVFVTKSASSKADFERQMYVLRRFSVMSIREVLGVKNGGTKDFYMCSLSSRTIVYKGQLKPSQLKGYFFADLGDESFTSYMALIHSRFSTNTFPSWDRAQPMRVLGHNGEINTLRGNKNWMKAREGLLKCEGLGLTRDEMLKLLPIVDATSSDSGAIDNVLELLIQSGRSAPEAVMMMIPEAWQNDVNMDPERKALYEFFSALMEPWDGPALISFTDGRYLGATLDRNGLRPGRFYVTYSGRVIMASEVGVVDVPPQDVSRKGRLNPGMMLLVDFENHCVVNDDELKKEYSKVRPYGEWLKRQRIQLTDIIESVNEAERIAPSISGALPITKENKADMGICGILTPLKAFGYTREALEMLMLPMAKDGQEALGSMGNDTPLAVMSNREKLTFEYFKQMFAQVTNPPIDPIREKIVTSMECMIGPEGDLSETTERQCHRLTLKSPLLNTNEMEAIKKMNYRGWRSKVLDITYPKKNGRMGLKQTLDKICAQAREAIHEGYTILVLSDRGFSSERVAVSSLLAVGAVHQHLVSHLERTRIGLLVESAEPREVHHFSTLIGFGADAICPYLAIEAIWRLQIDGRIPPNDGKPYTQEQLIEKYFYASNYGMMKVLAKMGISTLASYKGAQIFEALGLASEVVSKCFEGTPSRVEGATFEMLAQDALRLHEIAFPSRTLPPGSADANALPNPGDYHWRKNGEVHLNDPFSIAKLQEAARINSREAYKEYSRRIYELNKACTLRGMLKFREIPNQISLDEVEPAKEIVKRFCTGAMSYGSISLEAHTSLAEAMNTLGGKSNTGEGGEQPCRMVPLPDGSKNPRISAIKQVASGRFGVSIYYLTNAVEVQIKMAQGAKPGEGGELPGHKVIGDIAVTRNSTAGVGLISPPPHHDIYSIEDLAQLIHDLKNANPGARISVKLVSEAGVGIVASGVVKGHADHVLISGHDGGTGASRWTGIKNAGLPWELGLAETHQTLVANGLRGRAVLQTDGQMKTGRDVAVACLLGAEEFGFSTAPLITLGCIMMRKCHTNTCPAGIATQDPVLRAKFAGKPEHVINYFFMLAEEVREIMAQLGFRTVNEMVGRSDMLEIDPKVLEGNEKLENIDLSRLLKPAAEISPGAVQYCVEKQDHGLDMALDNKLIASSTAALRKGVRVFIETPVRNINRAVGTMLSHEVTKRYHIHGLPSDTIHIKLNGSAGQSFGAFLCPGITLELEGDSNDYVGKGLSGGKIVVYPPRNSRFNPQDNIVIGNVALYGATKGEAYFNGMAAERFCVRNSGAQAVVEGIGDHGCEYMTGGTAVILGKTGRNFAAGMSGGIAYVYDVDGKFSSRCNYELVDLYAVVEEDDITTLRMMIQQHRLHTQSDLARDILLNFDTLLPKFIKVYPRDYKRVLDKLKEEKAAKEAEQKAREVVDKKPVEVIQAPNGISVKTEKVMNEEPSSRPSRVSNAVKYRGFIKYEREGTSYRDPNERVKDWNEVAIELVPGPLLKTQSARCMDCGTPFCHQEGSGAGCPLGNKIPEFNELVHQNRWHEALDRLLETNNFPEFTGRVCPAPCEGSCVLGIIDNPVSIKSIECAIIDKGFEEGWMVPRPPLRRTGKRVAIVGSGPAGLAAADQLNKMGHFVTVFERADRIGGLMMYGVPNMKADKEGIVQRRVELMAKEGVQFIVNAHVGSDPLYSVEKLRSENDAIILACGATKPKDLPIPGRELAGIHFAMEFLHANTKSLLDSNLEDGNYISAQGRKVVVIGGGDTGTDCIGTSIRHGCTNLVNLELLPEPPRKRAPDNPWPQWPRIFRVDYGHQEATSKFGKDPRSYKVLTKRFIGDENGNVKALEVIRVEWGKVNGRFQFKEVEGSEEIIEADLVLLAMGFLGPEATVANKLGLEQDMRSNFKAQFGNFATNVEGVFAAGDCRRGQSLVVWAITEGRQAAAAVDNYLSKDDEGETNGTEDIAVSSEGLVQPVVA

SEQ ID NO: 1526 - protein, 356 aa, Oryza sativa; identical to SEQ ID NO: 1050

SEQ ID NO: 1527 - protein, 584 aa, Oryza sativa
MDSSYQHDKPLLDEENSSQVTLEYTGDGSVCIRGHPALRKHTGNWKGSSLAIVFSFCSYLAFTSIVKNLVSYLTKVLHETNVAAARDVATWSGTSYLAPLVGAFLADSYLGKYCTILIFCTIFIIGLMMLLLSAAVPLISTGPHSWIIWTDPVSSQNIIFFVGLYMVALGYGAQCPCISSFGADQFDDTDENERTKKSSFFNWTYFVANAGSLISGTVIVWVQDHKGWIWGFTISALFVYLGFGTFIFGSSMYRFQKPGGSPLARICQVVVAAIHKRDKDLPCDSSVLYEFLGQSSAIEGSRKLEHTTGLKFFDRAAMVTPSDFESDGLLNTWKICTVTQVEELKILIRMFPVWATMILFAAVLDNMFSTFIEQGMVMEKHIGSFEIPAASFQSIDVIAVLILVPVYERVLVPVFRKFTGRANGITPLQRMGIGLFFSMLSMVSAALVESNRLRIAQDEGLVHRKVAVPMSILWQGPQYFLIGVGEVFSNIGLTEFFYQESPDAMRSLCLAFSLANVSAGSYLSSFIVSLVPVFTAREGSPGWIPDNLNEGHLDRFFWMMAGLCFLNMLAFVFCAMRYKCKKAS

SEQ ID NO: 1528 - protein, 533 aa, Oryza sativa
MDSSTVGAPGSSLHGVTGREPAFAFSTEVGGEDAAAASKFDLPVDSEHKAKTIRLLSFANPHMRTFHLSWISFFSCFVSTFAAAPLVPIIRDNLNLTKADIGNAGVASVSGSIFSRLAMGAICDMLGPRYGCAFLIMLAAPTVFCMSLIDSAAGYIAVRFLIGFSLATFVSCQYWMSTMFNSKIIGLVNGLAAGWGNMGGGATQLIMPLVYDVIRKCGATPFTAWRLAYFVPGTLHVVMGVLVLTLGQDLPDGNLRSLQKKGDVNRDSFSRVLWYAVTNYRTWIFVLLYGYSMGVELTTDNVIAEYFYDRFDLDLRVAGIIAASFGMANIVARPTGGLLSDLGARYFGMRARLWNIWILQTAGGAFCLLLGRASTLPTSVVCMVLFSFCAQAACGAIFGVIPFVSRRSLGIISGMTGAGGNFGAGLTQLLFFTSSRYSTGTGLEYMGIMIMACTLPVVLVHFPQWGSMFLPPNAGAEEEHYYGSEWSEQEKSKGLHGASLKFAENSRSERGRRNVINAAAAAATPPNNSPEHA

SEQ ID NO: 1529 - protein, 516 aa, Oryza sativa
MEAKPVAMEVEGVEAAGGKPRFRMPVDSDLKATEFWLFSFARPHMASFHMAWFSFFCCFVSTFAAPPLLPLIRDTLGLTATDIGNAGIASVSGAVFARLAMGTACDLVGPRLASASLILLTTPAVYCSSIIQSPSGYLLVRFFTGISLASFVSAQFWMSSMFSAPKVGLANGVAGGWGNLGGGAVQLLMPLVYEAIHKIGSTPFTAWRIAFFIPGLMQTFSAIAVLAFGQDMPGGNYGKLHKTGDMHKDSFGNVLRHALTNYRGWILALTYGYSFGVELTIDNVVHQYFYDRFDVNLQTAGLIAASFGMANIISRPGGGLLSDWLSSRYGMRGRLWGLWTVQTIGGVLCVVLGIVDFSFAASVAVMVLFSFFVQAACGLTFGIVPFVSRRSLGLISGMTGGGGNVGAVLTQYIFFHGTKYKTETGIKYMGLMIIACTLPVMLIYFPQWGGMLVGPRKGATAEEYYSREWSDHEREKGFNAASVRFAENSVREGGRSSANGGQPRHTVPVDASPAGV

SEQ ID NO: 1530 - protein, 593 aa, Oryza sativa
MDAGEIIVAQPSPRLYKSLTFRRIATKERTIPQDEEMKIRSPRFQDESLTAPFILDKKARSKAPTVVLGFECLESTAFNGIATNLVVYLETLLHGSNLASASNVTTWFGTSYLTPVFGAIIADTFWGNYNTILVSLVFYLLGMMLVTFSAFLPTTALCTVVGSSCQQPLLGAQTIAFLGLYLVAFGSGGVRAALLPFGADQFDDDNTADRERKMSFFSWFYICVDFGMIVSGLFIVWIQQNVSWGLGFGIATACIALAFGGFVLATPMYKRRMPTGTPIKSLAQVVVAACRKARLRVPADTTLLYEVHDKINQSKIAHTDQFGFLDKAAVVMESDLEEESNDVAADASWRICTVTQVEELKILLRLLPIWATSIVLSAAYAQLNTTFVQQGAAMNMRIMSFTIPPASMVSFEVLCVLAWVLMYSSVIVPMLNSLSLANGEPSQLQRMGAGRLLMAFAMAVAALVEMMRLDAAGRGESLSIAWQMPQYFALAGAEVFCYIAQLEFFYSEAPESMKSMCTSLALLTVALGSYMSSFIYAVVNAFTAVDGRPGWISDNLNEGHMDYFFWVMAALCTLNFVVYSAFARTYRVKLVVS

SEQ ID NO: 1531 - protein, 547 aa, Oryza sativa
MASTDTEQQEHAVALLQPEVEEAYTTDGSLGVDGNPALKHRTGGWMACRPILGTEFCYCLAYYGITFNLVTYLTAELHQSNVAAANNVSTWQATCFLTPLAGAVAADSYWGRYRTMVVSCCIGVAGMLMAALSALLPLLIKDTSSMASAQVIILFLGLYMIAFGVGGLRPCLMSFGADQFDDGDTSERISKGSYFNWYIFTMNCASVISTTAMVWVQDHYGWALGLGIPAMVLAVGLSCLVAASRAYRFQTTRGSPLTRVCQVVVAAVRKFNVAPPADMALLYDLSEDASSMKGVQRIEHTADLRFFDKAAVVTASDEEAEGAAPRNPWRLCVVTQVEELKILVRMLPLWACVAFYYTATAQANSTFVEQGMAMDTRVGSFHVPPASLATFQIITTIVLIPLYDRAFVPAARRLTGREKGISDLLRIGGGLAMAALAMAAAALVETRRARAAHAGMEPTSILWQAPQYVLVGVGELLATVGQLDFFYSQAPPAMKTVCTALGFISVAAGEYLSSLVVTAVSWATATGGRPGWIPDDLNEGHLIASSG

SEQ ID NO: 1532 - protein, 328 aa, Oryza sativa
MEHCNGIAAVGRWLSTKPKVIFVLGATATGKSKLAIRLAARFDGEVINSDKIQAHDGFPVITNKVTDEERAGVAHHLLGGVSPDADFTAEDFRREAAAAVARVHAAGRLPVVAGGSNIYVEALVAGGGGAFLAAYDCLFLWTDVAPDLLRWYTAARVDDMVRRGLVGEARAGFDAGADYTRGVRRAIGLPEMHGYLLAEREGGAGAEDDDDLLAGMLEAAVREIKDNTFRLTVSQVAKIRRLSALPGWDVRRVDATAVVARMAEGAPHGETWREVVWEPCEEMVSRFLETPAAAAAVVANGKVDVNVGDAAAGVPEAAAAAVVAAGVV

SEQ ID NO: 1533 - protein, 295 aa, Oryza sativa; identical to SEQ ID NO: 1132

SEQ ID NO: 1534 - protein, 175 aa, Oryza sativa
MAPSVMASSATTVAPFQGLKSTAGMPVARRSGNSSFGNVSNGGRIRCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 1535 - protein, 321 aa, Oryza sativa
MKFAKKYEKYMKGMDEELPGVGLKRLKKLLKKCRSDLQSHENDGSSAGRCPGHCSVCDGSFFPSLLNEMSAVIGCFNEKAKKLLELHLASGFKKYTMWFTSKGHKSHGALIQQGKDLVTYAIINAVAMRKILKKYDKIHYSKQGQEFKAQAQSLHIEILQSPWLCELMAFYMNLRRSKKNNGAMELFGDCSLVFDDDKPTISCNLFDSMRVDISLTCSICLDTVFDPVALSCGHIYCYLCSCSAASVTIVDGLKSAERKSKCPLCRQAGVFPNAVHLDELNMLLSYSCPEYWEKRIQMERVERVRLAKEHWESQCRAFLGM

SEQ ID NO: 1536 - protein, 534 aa, Oryza sativa
MGGGGGEQQQLEVLHALDVAKTQWYHFTAIVVAGMGFFTDAYDLFCISLVTKLLGRIYYRVDGSPSPGTLPPHVSASVNGVAFVGTLSGQLFFGWLGDKLGRKRVYGITLMLMVLCSLASALSFGHTPTSVMATLCFFRFWLGFGIGGDYPLSATIMSEYANKKTRGAFIAAVFAMQGFGIITGGLVAILVSASFRAAFPAPPYGEDPVASTPPQADFVWRIILMLGALPAALTYYWRTKMPETARYTALVANNAKQAAADMSKVLQVVEMRNIGNNGGSRRPFGLFSGEFVRRHGLHLVGTSATWLLLDIAFYSQNLFQKDIFSAVGWIPKAATMSALEELFRIARAQTLIALCGTVPGYWFTVALIDVVGRFKIQAVGFFMMTLFMLTLALPYHHWTAPGKNHVGFLLLYGLTFFFANFGPNSTTFIVPAEIFPARLRATCHGISAASGKLGAIVGSFGFLYLAQSPDRSKTEHGYPPGIGVRNSLFLLAACNLLGLLFTFLVPESKGKSLEEMSGDAEAQEEAPPPLQTVL

SEQ ID NO: 1537 - protein, 427 aa, Oryza sativa
MGRHSCCYKQKLRKGLWSPEEDEKLMNHITKHGHGCWSSVPKLAGLQRCGKSCRLRWINYLRPDLKRGAFSQEEEDLIIELHAVLGNRWSQIAAQLPGRTDNEIKNLWNSCIKKKLRQKGIDPNTHKPLTEADRRGAAPTVSTERTSGSSDVNPSSAGALGNLSHLLSETAQSSMLLPVYDKNHPETASLPRPKVPPKELFLDQLTAGHESPSSCRSSGPTLYFPFQQPLGYSNECGTGDGASMNSLWFNQNDFNCSTISTVMPPVSPSALSTSMGLNLPPENPRHGGTGIGNTPFYWDGSNPSSSGSTGSSGSNSMGFEPQSTTSILENSVFPWTDIGQEKDTRVHLVEELKWPDLLHGTFAEATTAMQNQSQSLYDDVIKAESQFNMEGICASWFQNQQPQQQLQAASDMYDKDLQRLPLSFEHI

SEQ ID NO: 1538 - protein, 527 aa, Oryza sativa; identical to SEQ ID NO: 1307

SEQ ID NO: 1539 - protein, 361 aa, Oryza sativa; identical to SEQ ID NO: 1148

SEQ ID NO: 1540 - protein, 387 aa, Oryza sativa
MAGGGGGEGKVACAAWIRRREEKEKATRVFAAYGRAGSPPAVEVLGFDSKECSLSEPLARAELGEEPGDAPRGITVHPSGDELVCATAKGCRLFKLIFEEFTVRLISRDAPPLESVGPQKCLAFSTDGSKFAIGGEDGHLRIFHWPSMNVLLDEPKAHKSFRDMDISLDSEFLVSTSTDGSARIWKIDEGVPLVNLTRSADEKIECCRFSRDGMKPFLFCTVAKGNKVVTVVWNISDWSRIGYKRLLGKPISTLSVSMDGKYLALGSHDGDFCAVDVKKMDVSHWSKKVHLGSPVSSIEFCPTERAVISTSHQWGAELTKLNVPADWKEWQVWLILLSLFLVSAILFYMFYERSDSFWNFPMGQHQPAKPWSVMKESPPVPEDQNPW

SEQ ID NO: 1541 - protein, 428 aa, Oryza sativa; identical to SEQ ID NO: 1304

SEQ ID NO: 1542 - protein, 893 aa, Oryza sativa
MPLDPDSSPAPPHRDWFFPPAPPFLPSSRARTPRAPFPSTSRSSNPYSFPDRRPPPTPRSRSRSPLPPPEQQKQQQPPPTTPPPAPRRRDPRYAGVRRGDVRTLTAEKAAAAAAVPTAAQVHGSKSAASATTLRWSGMVSVAAIVLCFSSLVRSNSSLHDQVHHLKAQLAEATTKLQSCITESSMDMSSILSYQSNNSTSQNRGLKNFSLLLSLSTLYAPLLILKYMDLFLKLRSSQDSEEEVPINKRLAYRVDIFLSLQPYAKPLVLLVATLLLIGLGGLALYGVNDDSLLDCLWLSWTFVADSGNHANAEGFGPKLVSVSISIGGMLVFAMMLGLVTDSISEKFDSLRKGRSEVIEQSHTLVLGWSDKLGSLLNQIAIANESLGGGTIVVMAEKDKEEMEADIAKMEFDLKGTAIICRSGSPLILADLKKVSVSKARAIVVLAEEGNADQSDARALRTVLSLTGVKEGLRGHIVVELSDLDNEVLVKLVGGDLVETVVAHDVIGRLMIQCARQPGLAQIWEDILGFENCEFYIKRWPQLDGMQFEDVLISFPDAIPCGIKVASYGGKIILNPDDFYVLQEGDEVLVIAEDDDTYAPAPLPKVMRGYLPKDFVVPKSPERILFCGWRRDMEDMIMVLDAFLAPGSELWMFNDVPEMDRERKLIDGGLDFSRLENITLVHREGNAVIRRHLESLPLESFDSILILADESVEDSAIQADSRSLATLLLIRDIQAKRLPFREAMVSHVTRGSFCEGSWIGEMQQASDKSVIISEILDPRTKNLLSVSKISDYVLSNELVSMALAMVAEDRQINDVLEELFAEQGNEMQIRPADLYLREDEELNFFEVMLRGRQRKEIVIGYRLVDAERAIINPPDKVSRRRWSAKDVFVVITEKE

SEQ ID NO: 1543 - protein, 510 aa, Oryza sativa; identical to SEQ ID NO: 1117

SEQ ID NO: 1544 - protein, 606 aa, Oryza sativa; identical to SEQ ID NO: 1057

SEQ ID NO: 1545 - protein, 374 aa, Oryza sativa
MATPRTLVPILPPVAALLLLLVAASSIPILAAAQPADACGGAPDQAAADGACHDVPRALRLKLIAIPTILVSSVVGVCLPLLSRSVPALRPDGGLFAVVKAFASGVILATGYMHVLPDAFNNLTSPCLPRKPWSEFPFAAFVAMLAAVSTLMADSLMLTYYNRSKPRPSSGGDVAAVADHGESPDQGHRHGHGHGHGHGMAVAKPDDVEATQVQLRRNRVVVQVLEIGIVVHSVVIGLGMGASQNVCTIRPLVAAMCFHQMFEGMGLGGCILQAEYGRRMRSVLVFFFSTTTPFGIALGLALTRVYRDNSPTALIVVGLLNAASAGLLHYMALVELLAADFMGPKLQGNVRLQLAAFLAVLLGAGGMSVMAKWA

SEQ ID NO: 1546 - protein, 332 aa, Oryza sativa
MEAQNQEVAALVEKIAGLHAAISKLPSLSPSAEVDALFTDLVTACVPASPVDVAKLGPEAQAMREELIRLCSAAEGHLEAHYADMLAAFDNPLDHLARFPYYGNYVNLSKLEYDLLVRYVPGIAPTRVAFVGSGPLPFSSLVLAAHHLPDAVFDNYDRCGAANERARRLFRGADEGLGARMAFHTADVATLTGELGAYDVVFLAALVGMAAEEKAGVIAHLGAHMADGAALVVRSAHGARGFLYPIVDPEDVRRGGFDVLAVCHPEDEVINSVIVARKVGAAAAAAAARRDELADSRGVVLPVVGPPSTCCKVEASAVEKAEEFAANKELSV

SEQ ID NO: 1547 - protein, 358 aa, Oryza sativa; identical to SEQ ID NO: 947

SEQ ID NO: 1548 - protein, 203 aa, Oryza sativa; identical to SEQ ID NO: 1255

SEQ ID NO: 1549 - protein, 216 aa, Oryza sativa
MVLWVFGYGSLIWNPGFDFDEKILGFVKGYKRTFNLACIDHRGTPEHPARTCTLESDEEAICWGIAYCVKGGLKKEQEAMKYLERRECEYDQKISVDFYKEGDSLKPAVTGVLVFVSTPDPVGNKYYLGPAPLEDMARQIATANGPNGNNRDYLFSMEKALSNICHEDDSIIELANEVRKVLSRPKEKITGSDSPQKSHALVHLSALPEGTVVDSR

SEQ ID NO: 1550 - protein, 1121 aa, Oryza sativa; identical to SEQ ID NO: 1245

SEQ ID NO: 1551 - protein, 298 aa, Oryza sativa
MTSGAAAAGRTPTWKERENNKRRERRRRAIAAKIFTGLRALGNYNLPKHCDNNEVLKALCREAGWVVEDDGTTYRKGCKPPPSSAGGASVGMSPCSSTQLLSAPSSSFPSPVPSYHASPASSSFPSPSRIDNPSASCLLPFLRGLPNLPPLRVSSSAPVTPPLSSPTASRPPKIRKPDWDVDPFRHPFFAVSAPASPTRGRRLEHPDTIPECDESDVSTVDSGRWISFQMATTAPTSPTYNLVNPGASTSNSMEIEGTAGRGGAEFEFDKGRVTPWEGERIHEVAAEELELTLGVGAK

SEQ ID NO: 1552 - protein, 205 aa, Oryza sativa; identical to SEQ ID NO: 1000

SEQ ID NO: 1553 - protein, 512 aa, Oryza sativa
MATFFRSANLASRVFDRQFLSPRPGATVNTVRQFYENLVPSYTICDIDCPDYSFRKFTDDGNYLVAFSRNHQDLIVYRPIWPTFSCNEPCDSHDLPPKAKKFDSFFKQLYSISLASSNEYICKDFFLYMECHQFGLFATSTAQSNDSSATEGAIHGVPSIEKITFYLVRLDDGAILDEKAFRNDFINLAHSIGAYLYEDLLCIVSLRYQTIHVLQIRDSGNLVEVRKIGAFCQEDDELFLHSHGQAARGVSFLPGIKQRLLSFIFRKTWNEESDQTLRVQHLKKKFYFHFQDYVDLIIWKVQFLDRHHLFIKFGSVDGGVSRSTEQNSAFFAVYNMETTDIVSLYQNSSEELYSLFEYFYDHFHTNPQNSSHGNFISSHSNNVHALDQLRTIKNKANSTSQQFVKKMMASLPYTCQSQSPSPYFDLSLFRYDEKLISAIDRHRHCTEHPIKFISVKQPNVVKFKIKPGSDSGASDSRAKRISSFLFHPFFPLALSIQQTYMQPTVVNLHFRR

SEQ ID NO: 1554 - protein, 362 aa, Oryza sativa; identical to SEQ ID NO: 1039

SEQ ID NO: 1555 - protein, 317 aa, Oryza sativa; identical to SEQ ID NO: 1052

SEQ ID NO: 1556 - protein, 297 aa, Oryza sativa; identical to SEQ ID NO: 1469

SEQ ID NO: 1557 - protein, 859 aa, Oryza sativa
MAAAMVAAVHGVGRQDRSSPGGGGAPQVDTGKYVRYTPEQVEALERVYGECPKPSSLRRQQLIRECPILSNIEPKQIKVWFQNRRCREKQRKEASRLQTVNRKLTAMNKLLMEENDRLQKQVSRLVYENGYMRQQLHNPSVATTDTSCESVVTSGQHHQQQNPAATRPQRDANNPAGLLAIAEETLAEFLSKATGTAVDWVQMVGMKPGPDSIGIIAVSHNCSGVAARACGLVSLEPTKVAEILKDRPSWYRDCRCVDVLHVIPTGNGGTIELIYMQTYAPTTLAAPRDFWILRYTSGLEDGSLVICERSLTQSTGGPSGPNTPNFVRAEVLPSGYLIRPCEGGGSMIHIVDHVDLDAWSVPEVLRPLYESPKILAQKMTIAALRHIRQIAHESSGEMPYGGGRQPAVLRTFSQRLSRGFNDAVNGFPDDGWSLMSSDGAEDVTIAFNSSPNKLVGSHVNSSQLFSAIGGGILCAKASMLLQNVPPALLVRFLREHRSEWADPGVDAYSAAALRASPYAVPGLRAGGFMGSQVILPLAHTLEHEEFLEVIRLEGHSLCHDEVVLSRDMYLLQLCSGVDENAAGACAQLVFAPIDESFADDAPLLPSGFRVIPLDGKTDAPSATRTLDLASTLEVGSGGTTRASSDTSSTCNTRSVLTIAFQFSYENHLRESVAAMARQYVRTVVASVQRVAMAIAPSRLGGQIETKNPPGSPEAHTLARWIGRSYRFHTGADLLRTDSQSTDSSLKAMWQHSDSIMCCSLKAAPVFTFANQAGLDMLETTLIALQDISLEKILDDDGRKALCTEFPKIMQQGFAYLPGGVCVSSMGRPVSYEQAVAWKVLSDDDTPHCLAFMFVNWSFV

SEQ ID NO: 1558 - protein, 508 aa, Oryza sativa; identical to SEQ ID NO: 1075

SEQ ID NO: 1559 - protein, 582 aa, Oryza sativa
MKPSDDKAQLSGLAQSEESSLDVDHQSFPCSPSIQPVASGCTHTENSAAYFLWPTSNLQHCAAEGRANYFGNLQKGLLPRHPGRLPKGQQANSLLDLMTIRAFHSKILRRFSLGTAVGFRIRKGDLTDIPAILVFVARKVHKKWLNPAQCLPAILEGPGGVWCDVDVVEFSYYGAPAQTPKEQMFSELVDKLCGSDECIGSGSQVASHETFGTLGAIVKRRTGNKQVGFLTNHHVAVDLDYPNQKMFHPLPPNLGPGVYLGAVERATSFITDDVWYGIYAGTNPETFVRADGAFIPFADDFDISTVTTVVRGVGDIGDVKVIDLQCPLNSLIGRQVCKVGRSSGHTTGTVMAYALEYNDEKGICFFTDILVVGENRQTFDLEGDSGSLIILTSQDGEKPRPIGIIWGGTANRGRLKLTSDHGPENWTSGVDLGRLLDRLELDIIITNESLQDAVQQQRFALVAAVTSAVGESSGVPVAIPEEKIEEIFEPLGIQIQQLPRHDVAASGTEGEEASNTVVNVEEHQFISNFVGMSPVRDDQDAPRSITNLNNPSEEELAMSLHLGDREPKRLRSDSGSSLDLEK

SEQ ID NO: 1560 - protein, 316 aa, Oryza sativa; identical to SEQ ID NO: 1131

SEQ ID NO: 1561 - protein, 579 aa, Oryza sativa; identical to SEQ ID NO: 1135

SEQ ID NO: 1562 - protein, 259 aa, Oryza sativa
MTSSLSSSTASAAACCKSRSRNPPPAPAPHTSTARVVRSSRRRLLLVFFSAEAAAAATSGLIQTPCGQAYPFAGTNVKKPQPPSTPYSQSQSQQQFGLDAKGRIRACPSTNPGCVSTNPTVGASCSLASPLIVPANTPTDKAAAVSSLREAILKTQRNAVIKADEETAYGHYIQAEVDGGAGRDVMEFLLKESQSQSQEVVAAYRCVATKVIFVYPFTTAVGDSRGQSQRIAAVAQELGWYAPDLLNAATADDHSILDY

SEQ ID NO: 1563 - protein, 535 aa, Oryza sativa; identical to SEQ ID NO: 1096

SEQ ID NO: 1564 - protein, 579 aa, Oryza sativa; identical to SEQ ID NO: 1135

SEQ ID NO: 1565 - protein, 187 aa, Oryza sativa; identical to SEQ ID NO: 1136

SEQ ID NO: 1566 - protein, 228 aa, Oryza sativa
MARERREIKRIESAAARQVTFSKRRRGLFKKAEELSVLCDADVALIVFSSTGKLSHFASSSMNEIIDKYNTHSNNLGKAEQPSLDLNLEHSKYAHLNEQLAEASLRLRQMRGEELEGLSIDELQQLEKNLEAGLHRVMLTKDQQFMEQISELQRKSSQLAEENMQLRNQVSQISPAEKQVVDTENFVTEGQSSESVMTALHSGSSQSQDNDDGSDVSLKLGLPCGAWK

SEQ ID NO: 1567 - protein, 316 aa, Oryza sativa; identical to SEQ ID NO: 1131

SEQ ID NO: 1568 - protein, 623 aa, Oryza sativa
MYSANHWGGSFEIAADGAAEDDHSRNMDLDRGALSARQHQLDETQQSWLLGPPEAKKKDKYVDLGCVVVKRKLLWWVLWTLLAAFILIGLPVIIAKSIPKKKPHAPPPDQYTDALHKALLFFNAQKSGRLPKNNGIKWRGNSGLSDGSDLTDVKGGLVGGYYDAGDNIKFHFPLAFSMTMLSWSVIEYSAKYKAVGEYDHVRELIKWGTDYLLLTFNSSASTIDKVYSQVGIAKINGTQPDDHYCWNRPEDMAYPRPVQTAGSAPDLGGEMAAALAAASIVFRDNAAYSKKLVNGAAAVYKFARSSGRRTPYSRGNQYIEYYYNSTSYWDEYMWSAAWMYYATGNNTYITFATDPRLPKNAKAFYSILDFSVFSWDNKLPGAELLLSRLRMFLNPGYPYEESLIGYHNTTSMNMCTYFPRFGAFNFTKGGLAQFNHGKGQPLQYTVANSFLAALYADYMESVNVPGWYCGPYFMTVDDLRSFARSQVNYILGDNPKKMSYVVGYGKKYPRRLHHRGASTPHNGIKYSCTGGYKWRDTKGADPNVLVGAMVGGPDKNDQFKDARLTYAQNEPTLVGNAGLVAALVALTNSGRGAGVTAVDKNTMFSAVPPMFPATPPPPSKWKP

SEQ ID NO: 1569 - protein, 395 aa, Oryza sativa; identical to SEQ ID NO: 1463

SEQ ID NO: 1570 - protein, 553 aa, Oryza sativa
MYRVKSESDCDMIHQEQMDSPVADDGSSGGSPHRGGGPPLKKGPWTSAEDAILVDYVKKHGEGNWNAVQKNTGLFRCGKSCRLRWANHLRPNLKKGAFTAEEERLIIQLHSKMGNKWARMAAHLPGRTDNEIKNYWNTRIKRCQRAGLPIYPTSVCNQSSNEDQQCSSDFDCGENLSNDLLNANGLYLPDFTCDNFIANSEALPYAPHLSAVSISNLLGQSFASKSCSFMDQVNQTGMLKQSDGVLPGLSDTINGVISSVDQFSNDSEKLKQAVGFDYLHEANSTSKIIAPFGGALNGSHAFLNGNFSASRPTSGPLKMELPSLQDTESDPNSWLKYTVAPALQPTELVDPYLQSPAATPSVKSECASPRNSGLLEELIHEAQTLRSGKNQQTSVISSSSSVGTPCNTTVLSPEFDMCQEYWEEQHPGPFLNDCAPFSGNSFTESTPPVSAASPDIFQLSKVSPAQSTSMGSGEQVMGPKYEPGDTSPHPENFRPDALFSGNTADPSVFNNAIAMLLGNDLSIDCRPVLGDGIMFNSSSWSNMPHACEMSEFK

SEQ ID NO: 1571 - protein, 812 aa, Oryza sativa; identical to SEQ ID NO: 1153

SEQ ID NO: 1572 - protein, 240 aa, Oryza sativa
MAAAAPSRVSVRAAAPGQTGGFAKIRPQVVVAAAARSAGVSGRRARSVRASLFSPKPATPKDARPAKVQEMFVYEINERDRESPAYLRLSAKQTENALGDLVPFTNKLYSGSLDKRLGISAGICILIQHVPERNGDRYEAIYSFYFGDYGHISVQGPYLTYEESYLAVTGGSGVFEGAYGQVKLNQIVFPFKIFYTFYLKGIPDLPRELLCTPVPPSPTVEPTPAAKATEPHACLNNFTN

SEQ ID NO: 1573 - protein, 512 aa, Oryza sativa; identical to SEQ ID NO: 1375

SEQ ID NO: 1574 - protein, 478 aa, Oryza sativa
MELGVPLPRRPVPGSYGVPFVSAVRDRLDFYYLQGQDKYFESRAERYGSTVVRINVPPGPFMARDPRVVALLDAKSFPVLFDVAKVEKRDVFTGTFMPSTSLTGGYRVCAYLDPSEPNHAKIKQLLLSLLVSRKDAFVPVFRSNFGALLDTVESQLASGGGKSDFTALNDATSFEFIGEAYFGVRPSASSSLGTGGPTKAALWLLWQLAPLTTLGLPMIIEDPLLHTLPLPPFLISSDYKALYAYFAAAASQALDAAEGLGLSREEACHNLLFATVFNSYGGFKLLLPQILSRVAQAGEKLHERLAAEIRSAVADAGGNVTLAALEKMELTRSVVWEALRLDPPVRFQYGRAKADLEIESHDASFAIKKGEMLFGYQPCATRDPRVFGATAREFVGDRFVGEEGRKLLQYVYWSNGRETENPSVDNKQCPGKNLVVLVGRLLLVELFLRYDTFTAEAGKKVVITGVTKASTSAVNRTA

SEQ ID NO: 1575 - protein, 1017 aa, Oryza sativa; identical to SEQ ID NO: 1373

SEQ ID NO: 1576 - protein, 326 aa, Oryza sativa; identical to SEQ ID NO: 1360

SEQ ID NO: 1577 - protein, 1084 aa, Oryza sativa
MAGNEWINGYLEAILDSGGAAGGGGGGGGGGGGGGGGGGGGGGGGVDPRSPAAGAASPRGPHMNFNPTHYFVEEVVKGVDESDLHRTWIKVVATRNARERSTRLENMCWRIWHLARKKKQLELEGILRISARRKEQEQVRRETSEDLAEDLFEGEKADTVGELAQQDTPMKKKFQRNFSELTVSWSDENKEKKLYIVLISLHGLVRGDNMELGRDSDTGGQVKYVVELARALAMMPGVYRVDLFTRQVSSPEVDWSYGEPTEMLTSGSTDGEGSGESAGAYIVRIPCGPRDKYLRKEALWPYLQEFVDGALAHILNMSKALGEQVSNGKLVLPYVIHGHYADAGDVAALLSGALNVPMVLTGHSLGRNKLEQIMKQGRMSKEEIDSTYKIMRRIEGEELALDAAELVITSTRQEIDEQWGLYDGFDVKLEKVLRARARRGVSCHGRFMPRMVVIPPGMDFSSVVVPEDTSDGDDGKDFEIASPRSLPPIWAEVMRFLTNPHKPMILALSRPDPKKNITTLVKAFGECRPLRELANLILIMGNRDDIDEMSAGNASVLTTVLKLIDKYDLYGSVAFPKHHKQSDVPEIYRLTGKMKGVFINPALVEPFGLTLIEAAAHGLPIVATKNGGPVDIKNALNNGLLVDPHDQHAIADALLKLVADKNLWQECRKNGLRNIQLYSWPEHCRTYLTRIAGCRIRNPRWLMDTPADAAAEEEEALEDSLMDVQDLSLRLSIDGERGSSMNDAPSSDPQDSVQRIMNKIKRSSPADTDGAKIPAEAAATATSGAMNKYPLLRRRRRLFVIAVDCYGDDGSASKRMLQVIQEVFRAVRSDSQMSRISGFALSTAMPLPETLKLLQLGKIPPTDFDALICGSGSEVYYPSTAQCVDAGGRLRPDQDYLLHINHRWSHDGAKQTIAKLAHDGSGTNVEPDVESCNPHCVSFFIKDPNKVRTIDEMRERVRMRGLRCHLMYCRNATRLQVVPLLASRSQALRYLFVRWGLSVGNMYLIVGEHGDTDHEEMLSGLHKTVIIRGVTEKGSEQLVRSSGSYQREDVVPSESPLIAFTKGDLKADEIMRALKEVTKAASGM

SEQ ID NO: 1578 - protein, 504 aa, Oryza sativa
MAAAAVVHLSVHGRLRRSPELHARPYHRPSLLRCRAFKQEADNGGEEASSSPPPPTTAEARRRRKGPLYKLKAAIQGLAGSRSAAAEAYGGEYQRAVEKAEEIFFSVATQVGRYVITMMSSGVVLGVGFQLSGGDSQMNTLIWYSWLGGVIIGTMIGANSVLEEHCKAGPRNVVITGSTRGLGKALAREFLLSGDRVVIASRSPESVLQTINELEENIQEGLSVAKKKQREILLHAKVVGTSCDVCKPEDVKKLVNFAKDELGSIDIWINNAGTNKGFRPLVNFSDEDISQIVSTNLVGSLLCTREAMNVMQHQQKGGHVFNMDGAGSGGSSTPLTAVYGSTKCGLRQFQASLLKESRRSKVGVHTASPGMVLTDLLLSGSSLRNKQMFNLICELPETVARTLVPRMRVVKGSGKAINYLTPPRILLALVTAWVRRGRWFDEEGRAVYAAEADRIRNWAESRARFSFTDAMEMYTENTWVSVFSLSVVCAFIILSSSGGPLPGT

SEQ ID NO: 1579 - protein, 609 aa, Oryza sativa
MGLPLPHHLGRAAAALSPRAHAARTPLAPFPPPSPASGDVHAEQPHDTCCFAACNWLLVAGGRRRVVLLAVDEEQLVGAEALLPHESAPSLGQHVALAAVPGRVTVCTPGGVGAAAVAAVGGFVAAAALAERAGVIAPRKRSNAPPAVPGLPIIGNLHQLKEKKPHQTFAKWAEIYGPIYTIRTGASSVVVLNSTEVAKEAMVAKFSSISTRKLSKALTVLTRDKSMVATSDYCDFHKMVKRYVMSSMLGTSAQKQFRDIRDMMIHNMLSTFHKLVKDDPHAPLIFRDVFKDELFRLSMIQSLGEDVSSVYVDEFGRDISKEEIYNATVTDMMMCAIEVDWRDFFPYLSWVPNKSFETRVFTTETRRTAVMRALIKQQKERIVRGEAKTCYLDFLLAENTLTDEQLMMLVWEALIEAADTTLVTTEWAMYELAKNPDKQERLYQEIREVCGDETVTEEHLPRLPYLNAVFHETLRRHSPVPLIPPRFVHEDTKLAGYDVPAGTEMVINLYGCNMNRKEWESPEEWVPERFAGGRLEVADMYKTMAFGAGRRACAGSLQATHIACAAVARFVQEFGWRLREGDEEKVDTVQLTAYKLHPLHVHLTRRGRM

SEQ ID NO: 1580 - protein, 254 aa, Oryza sativa
MEVLRYIFSCFSSSSSKSSSASAGSHRLWSSGASDKNKAMVEQLQRYGIIKSSKVAQVMETIDRGLFVPPGASPYFDSPMPIGYNATISAPHMHASCLELLEKHLQPGMRALDVGSGTGYLTACFAIMVGPEGRAVGVEHIPELVTSSIENIKKSAAAPQLTDGSLSIHITDGREGWPELAPYDAIHVGAAAPQIPQALIEQLKPGGRMVIPVGTMFQELKVVDKNQDGKVSIRDETAVRYVPLTSKDAQLQAN

SEQ ID NO: 1581 - protein, 286 aa, Oryza sativa
MCLAAAIASASASPARCLSPSSAALPRRFLHHLLLAATPPRPTPPPPPLRCIPFHRMAQFWTQGSLDKNKALVEYLKQYGAVRTDKVAEVMESIDRALFVAEGLTPYTDSPMPIGYNATISAPHMHATCLELLKDHLQPGMHALDVGSGSGYLTACFAMMVGPEGRAVGIEHIPELVAASTENVQRSAAAQLLKDGSLSFHVADGRLGWPDDAPYDAIHVGAAAPEIPQPLVDQLKTGGRMVIPVGSYFQELQVVDKNADGSVTVQNDASVRYVPLTSRSAQLQDS

SEQ ID NO: 1582 - protein, 580 aa, Oryza sativa
MGVAVHWRRAGDSLHMGGEPRARAEAAWAAALPAALVALVRDTATYTRMMHRLRMETPRGPTCQLDPCCCCCTAHVIPPPPPVSRTHATRRDAEASVPPPPASAAVSSRSDGTGQMAAGVTLACAAPPPLRAPRASDGGRRRGVVKGGAGTDTCRSPQRLNVRPRERERVRACVRARAKNHEHGQRRREAAVDPAMSGEYQFQDELAPLFARPGGGAGEMQMLPSSWFADYLQAGTPMQMDYDLMCRALELPVGEDVKREVGVVDVVAAGGGGAPPLTPNTTSSMSTSSSEGVGGGGGGGAGAGAGEEESPARCKKEEDENKEEGKGEEDEGHKNKKGSAAKGGKAGKGEKRARQPRFAFMTKSEVDHLEDGYRWRKYGQKAVKNSPYPRSYYRCTTQKCPVKKRVERSYQDPAVVITTYEGKHTHPIPATLRGSTHLLAAHAQAAAAAAAAHQLHHHHGHHGHHGMAPPLPLGSGAAAQFGRSSGIDVLSSFLPRAAAAHHGMTTMGGAAATTTTSHGLNSAISGGGGVSSETTSAVTVAASAQPSSPAALQMQHFMAQDLGLLQDMLLPSFIHGTNQP

SEQ ID NO: 1583 - protein, 171 aa, Oryza sativa
MPLQTIHKLKHQYTHNKSSSHQKKHTMINPKRLVHLAKKWQHMAALGRRRLTITGATKEGNLRCSSAIADKGHCIIYTADGERFGVPLTYLSTTVFGELLRLSEDEFGFTGEEKITLPCEAAVMEYVMCLLRRKPSEEVEQAVVSSVVMPCNYKSSTSMVSVNLSQSLAIF

SEQ ID NO: 1584 - protein, 527 aa, Oryza sativa; identical to SEQ ID NO: 1184

SEQ ID NO: 1585 - protein, 565 aa, Oryza sativa; identical to SEQ ID NO: 1008

SEQ ID NO: 1586 - protein, 250 aa, Oryza sativa
MAGGGGGGGRGEGEGRAATGKRERIAIRRIDNLAARQVTFSKRRRGLFKKAEELSILCDAEVGLVVFSATGKLFQFASTSMEQIIDRYNSHSKTLQRAEPSQLDLQGEDSSTCARLKEELAETSLRLRQMRGEELHRLNVEQLQELEKSLESGLGSVLKTKSKKILDEIDGLERKRMQLIEENLRLKEQLQVSRMSRMEEMQPGPDSEIVYEEGQSSESVTNASYPRPPPDNDYSSDTSLRLGLSLFSSK

SEQ ID NO: 1587 - protein, 224 aa, Oryza sativa
MARERREIRRIESAAARQVTFSKRRRGLFKKAEELAVLCDADVALVVFSSTGKLSQFASSNSMNEIIDKYTTHSKNLGKTDKQPSIDLNLEHSKCSSLNEQLAEASLQLRQMRGEELEGLSVEELQQMEKNLEAGLQRVLCTKDQQFMQEISELQRKGIQLAEENMRLRDQMPQVPTAGLAVPDTENVLTEDGQSSESVMTALNSGSSQDNDDGSDISLKLGLP

SEQ ID NO: 1588 - protein, 274 aa, Oryza sativa
MAAATSTMSLLPPITQQQRWHAADSLVVLASRCHNSRRRRRCRYVVPRARLFGPAIFEASKLKVLFLGVDEEKHQHPGKLPRTYTLTHSDVTARLTLAVSHTINRAQLQGWYNKLQRDEVVAEWKKVQGHMSLHVHCHISGGHVLLDLIAGLRYYIFRKELPVVLKAFVHGDGNLFSRHPELEEATVWVYFHSNLPRFNRVECWGPLRDAGAPPEEDDAVAAAAAEEAAAEQMPAAGEWPRRCPGQCDCCFPPYSLIPWPHQHDVAAADGQPQQ

SEQ ID NO: 1589 - protein, 353 aa, Oryza sativa
MSTIYMSQLPATLPLMEGDQDQGLYPAFHRAKDPPILFPFMIDSAVEHQGQIYGDQGLRRQQVLGESNQQFNDHMMMGGSDVFLTPSPFRPTIQSIGSDMIQRSSYDPYDIESNNKQHANGSTSKWMSTPPMKMRIIRKGAATDPEGGAVRKPRRRAQAHQDESQQQLQQALGVVRVCSDCNTTKTPLWRSGPCGPKSLCNACGIRQRKARRAMAAAANGGAAVAPAKSVAAAPVNNKPAAKKEKRAADVDRSLPFKKRCKMVDHVAAAVAATKPTAAGEVVAAAPKDQDHVIVVGGENAAATSMPAQNPISKAAATAAAAAASPAFFHGLPRDEITDAAMLLMTLSCGLVHS

SEQ ID NO: 1590 - protein, 175 aa, Oryza sativa; identical to SEQ ID NO: 1534

SEQ ID NO: 1591 - protein, 1366 aa, Oryza sativa
MESPTAGGGGGGGEAGAASSSSSSSGPSTSSAAAAATASASASSSAVATRYLAKRVLRGSAVLHVAQGCFRSPDCVDVVLCKENSLELVVIGEDGVLQSICEQTTFGIIKDVGVLNWRCTHFGLMPKIEGKEILVILSDSGKLSLLYFCSEMHRFFAIANIELSKPGNLRHRLGRILAIDRESRFVAVSAYEDEFAFVRVSVDHKLHAPNGGKISEKYFYPPEIEEDAKIISTAYNTSSIHGTVWSMCFISTCLDEEYYPVVAMIVNRGSDVNDLALYGLDSHKRTIDRISTYLEAGPLALEISEIPQLYGFALMFRAGDVLLMDLRNPKDISCIHRISLSTSLIGDHVSVEDSCRGLDVDDDVAACALLELRDSGNNMMRDDSYMDIDGTDNKAVVKSRIVCSWNWEPNAMQGHPRLIFCLDDGEFHLLEFSLDMEGVKVLPECVHRGLPCKPLLWMDKGMVVGFVEMGDGMILQLENNRLVHKSAIQNVAPILDLAIADHHGEKQDQMFACCGMCPEGSLRVIRNGVNVEKLLRTDPIYHGVTGLWTLRMKRTDAYHSFLVLSFVEETRILSVGLSFNDICDAVGFQTDVCTLACGLVADGLLVQIHSKCVKLCLPTACAHPEGTLLPSPVCADWYPDVTISVGAVGHNVVVVATSNPCCLYILGVRSLSSFQYELYEIQHVQLHYEVSCISIPQEDWRLDNSSSSCATSGDFRKDFAANIRKFAVIGTHEPSVHIISLEPGEAFQQLAVGHISVNNALGTPISGCIPENVRFVAAARFYILAGLRNGMLLRFESQTSKGHCFPGSFYKESSTPCDDTSLMLIAVRRIGITPVVLVPLHDRANADIIVLGDRPWLLQSARHSLAYSSISFLPASHVTPVSSTDCPSGLLFVSENCLHLVEMVHGKRLNAQKFSIGGTPRKVLYHSDSRTLLVLRTGLTSVSCSSDIVQIDPSNGALLSRFKCEPGETAKCMQIAKIGNDQVLIVGTSKSNGRPMMPNGEAESIKGRLILLSLETIESPRESGSFTAASNLNSSHAGSPFPEFVGYAAEELSSNSMCSSPDEVCCNQIQPELMAGHLRSLVQHTFNGAVLAVHPYLDRYVLAAAGNVLFVFGFLNESPHRIKKYTTSRTRFTITCLKTYASRIAVGDCRDGVLFYSYHENLRKLELIYSDPAQRLVGDVALLSCETAVVSDRRGSISVLSCPRLEVSESPEKNLAVHCSFYMGETAMSIQKVAFKHWLPIDDLTEPVLESVYNCVVASTLLGSIFVMIPLTSEEHQMLQDVQERLSVHPLTAPLLGNDHAEFRRRGIPSGVPPILDGDMLVQFLELTSEQQHDVLNIVSPGKKRQHDISVFQVMRALERVHYALN

SEQ ID NO: 1592 - protein, 533 aa, Oryza sativa
MAPPSHCHTINGGAPRNGAIPEVETTTSTPAASDTALLLDADEFRRLGHQVVDFIADYYAGLGDYPVHPSVTPGFLRRQLPADAPSRPEPEAFAAALRDVRDLILPGVTHWQSPRHFAHFPASSSTVGALGEALAAGINVVPFTWAASPAATELEMVVVDWLGRALHLPESLLFAGGGGGTILGTSCEAVLCALVAARDRKLAEIGARRIGDLVVYCSDQTHFAFRKAARIAGIPREHCREIPTCRDDVFALSPTALHAAMQADVDAGLVPLFLCATVGTTQTTAVDPVRELCAVAARHGGVWVHVDAAYAGSALVCPEFRDVIAGAEAVDSLSMNAHKWLLANNDCCAVWVAAPSALVAALGTEQEYILRDAAAEGHDVVDYKDWGTTLTRRFRALKVWLVLRCYGVEGLRSHVRSHVAMAAAFEAMVRGDARFEVVAPRRFALVCFRLRSPPERLGVGVGVGGEKAANELNRRLLEEVNAASSGPYMSSAMVGGVYMLRCAIGSTLTEERHVREAWKVVQERATSILRKRG

SEQ ID NO: 1593 - protein, 281 aa, Oryza sativa; identical to SEQ ID NO: 1483

SEQ ID NO: 1594 - protein, 592 aa, Oryza sativa; identical to SEQ ID NO: 1484

SEQ ID NO: 1595 - protein, 319 aa, Oryza sativa
MDGEWSDGAAVSSPTMSGGGGREQMKGGEDVAAADCPGSPVSPSPAAAQRSAAGAAASPSGRSRRSAQKRVVTVPLADVTGPRPKGVGEGNTPTDSWAWRKYGQKPIKGSPFPRAYYRCSSSKGCPARKQVERSRNDPDTVIVTYSFEHNHSATVPRAQNRQAAPQKPKAQACSPPEPVVEVEPEETHQYGVTAGPATGGGGGAAAIEVRDEFRWLYDVVSVPATSTSPSDIDAADEMQLYDQPMFFGGAVVGTAALLPDEFGDVGGLGGEGLGEEEALFEGLGELPECAMVFRRRAGDGLEMGGGVKIEQPAESTAMT

SEQ ID NO: 1596 - protein, 329 aa, Oryza sativa
MEQEAAMVVFSCNSGSGGSSSTTDSKQEEEEEEELAAMEEDELIHVVQAAELRLPSSTTATRPSSRYKGVVPQPNGRWGAQIYERHARVWLGTFPDEEAAARAYDVAALRFRGRDAVTNRAPAAEGASAGELAFLAAHSKAEVVDMLRKHTYDDELQQGLRRGSRAQPTPRWAREPLFEKAVTPSDVGKLNRLVVPKQQAERHFPFPLRRHSSDAAGKGVLLNFEDGDGKVWRFRYSYWNSSQSYVLTKGWSRFVREKGLRPGDTVAFSRSAAAWGTEKHLLIDCKKMERNNLATVDDDARVVVKLFGVDIAGDKTSYNDRSMDDPYHR

SEQ ID NO: 1597 - protein, 276 aa, Oryza sativa
MAFRLSNSLLGILNAVTFLLSVPVLGGGIWLATRADGTECERYFSAPVIAFGVFLLLVSLAGLVGACCRVNCLLWFYLVAMFVLIVVLFCFTVFAFVVTNKGAGEAVSGRGYKEYRLGDYSNWLQKRMENSKNWNRIRSCLQDSKVCKKLQDKNWDRTQFFKADLSPLESGCCKPPSSCNFLYVSGTNWTKVPTNSSDPDCNTWVDDGTQLCYNCQSCKAGAVATLKRDWKRVAVVCIVFLVFIVIVYSLGCCAFRNNRRDNRGAYRGAAWKGGYA

SEQ ID NO: 1598 - protein, 728 aa, Oryza sativa
MDASAGSSAPHSHGNPGKQGGGGGGGGGRGKAPAAEIRGEAARDDVFFADDTFPLLPDFPCLSSPSSSTFSSSSSSNSSSAFTTAAGGGCGGEPSEPASAADGFGELADIDQLLDLASLSVPWEAEQPLFPDDVGMMIEDAMSGQPHQADDCTGDGDTKAVMEAAGGGDDAGDACMEGSDAPDDLPAFFMEWLTSNREYISADDLRSIRLRRSTIEAAAARLGGGRQGTMQLLKLILTWVQNHHLQKKRPRTAIDDGAASSDPQLPSPGANPGYEFPSGGQEMGSAAATSWMPYQAFTPPAAYGGDAMYPGAAGPFPFQQSCSKSSVVVSSQPFSPPTAAAAGDMHASGGGNMAWPQQFAPFPVSSTSSYTMPSVVPPPFTAGFPGQYSGGHAMCSPRLAGVEPSSTKEARKKRMARQRRLSCLQQQRSQQLNLSQIHISGHPQEPSPRAAHSAPVTPSSAGCRSWGIWPPAAQIIQNPLSNKPNPPPATSKQPKPSPEKPKPKPQAAATAGAESLQRSTASEKRQAKTDKNLRFLLQKVLKQSDVGSLGRIVLPKKEAEVHLPELKTRDGVSIPMEDIGTSQVWNMRYRFWPNNKSRMYLLENTGDFVRSNELQEGDFIVIYSDIKSGKYLIRGVKVRRAAQEQGNSSGAVGKHKHGSPEKPGVSSNTKAAGAEDGTGGDDSAEAAAAAAAGKADGGGCKGKSPHGVRRSRQEAAAAASMSQMAVSI

SEQ ID NO: 1599 - protein, 609 aa, Oryza sativa; identical to SEQ ID NO: 1579

SEQ ID NO: 1600 - protein, 1615 aa, Oryza sativa; identical to SEQ ID NO: 1513

SEQ ID NO: 1601 - protein, 581 aa, Oryza sativa; identical to SEQ ID NO: 1197

SEQ ID NO: 1602 - protein, 310 aa, Oryza sativa
MNIGPREQRAFARMTPEDRAWLIKGKSVVLTCLASVLLLSAGSIKAPKTCTGGMFLGPIIAIGLFLIVMFVVGSCGLKKNDGDLYDCYLLGVFLAILLLLAFIIFGYVAVGGIDAGHAANAREYSLSECKRGWLRGRVTHSSHFWASTSACLRRSHVCNGMTNLVRNPDTGIFVPRPSSFERWAKRHGVDADPRVMSPIESGCCKPPSSCGLTYVNGTTWISTAASAGAPAAVAQVTNNNKDDDCSRWSNDHQTLCFQCDSCKAGFLRHTSQAWSVAAIYIVLAFIGLILSSLALYADQATGNNNTGRSR

SEQ ID NO: 1603 - protein, 272 aa, Oryza sativa
MAVSNNITACVNFLALVCAVPVVATGVWFASKQGDDCARVARWPLAILGAALLLVALAGFAGAYWNRRGLLAAYLFAMAALITLLLALLVFAFAVTRPSGAYPAFARAYDDYRLDGYSTWLRDRVAGDPRRWEGIRACLAASDTCRKLAQESVFFITPEQFYQSHLTPLQSGCCKPPTVCGYAYVSPTVWVNPANPAADADCAAWGNDPSQLCYECSSCKAGMLGTLREQWRRANVALVIATVALIFFYVIGCSAFKNAQTEDLFRRYKWRN

SEQ ID NO: 1604 - protein, 994 aa, Oryza sativa; identical to SEQ ID NO: 1203

SEQ ID NO: 1605 - protein, 179 aa, Oryza sativa; identical to SEQ ID NO: 1213

SEQ ID NO: 1606 - protein, 1172 aa, Oryza sativa; identical to SEQ ID NO: 1479

SEQ ID NO: 1607 - protein, 525 aa, Oryza sativa
MDPFLLSIILCSWIFVVVSWKKLNCMRRRLPPGPPRWPIFGNLLQLSPLPHKDFARFCTKYGPLVYLRLGTIDAITTDDPEVIREILIRQDEVFASRPRTLAAVHLAYGCGDVALAPLGPNWKRMRRVCMEHLLTTKRLESFAAHRALEAEHLCQFVWAKAQSGKPVNLREVLGAFSMNNVTRMLLGKQYFGLQSAGPGEAMEFMHITHELFWLLGLIYLGDYLPAWRWLDPYGCEKKMREVEKKVDDFHQKIIDEHRKAREAKKSASLDDDNKEDMDFVDVLLSLPGENGKEHMDDVEIKALMQDMIAAATDTSSVTNEWVMAEVIKNPRVLRKIQEELDGVVGRGRMVAESDLGQLTYLRCVVRESFRMHPAGPFLIPHESLKPTTIMGYDIPARTRIFINTHALGRNTRIWDDVDAFRPERHLPASADGGRVEISHLPDFKILPFSAGKRKCPGAPLGVILVLMALARLFHCFDWSPPDGLRPDDIDTQEVYGMTMPKAKPLVAVATPRLPPQMYGRHGKQV

SEQ ID NO: 1608 - protein, 276 aa, Oryza sativa; identical to SEQ ID NO: 1084

SEQ ID NO: 1609 - protein, 455 aa, Oryza sativa; identical to SEQ ID NO: 1231

SEQ ID NO: 1610 - protein, 463 aa, Oryza sativa
MAIGTVESVAVVAVPFPAQGHLNQLMHLSLLLASRGLDVHYAAPPAHLRQARLRLHGWDPDALRSIRFHDLDVPAYESPPPDPTAPPFPSHLMPMLESFAVAARVPLAALLERLSASYRRVVVVYDRLNSFAAAQAARLPNGEAFGLQCVAMSYNIGWLDPEHRLVREHGLQFHPVEACMTKEFVELISRAEQDEENAASSGILMNTSRALEAEFIDEIATHPMFKELKLFAAGPLNPLLDATARTPGQTRHECMDWLDKQPLASVLYVSFGTTSSLRGDQVAELAAALKGSKQRFIWVLRDADRANIFADSGESRHAELLSRFTAETEGVGLVITGWAPQLEILAHGATAAFMSHCGWNSTMESLSYGKPILAWPMHSDQPWDAELVCKYLKAGLLVRPWEKHSEVVPAEAIQEVIEEAMLPEKGMTIRRRAKELGEAVRASVADGGSSRKGLDDFVGYITR

SEQ ID NO: 1611 - protein, 463 aa, Oryza sativa
MAIGSVESVAVVAVPFPAQGHLNQLMHLSLLLASRGLDVHYAAPPAHLRQARSRLHGWDPDALRSIRFHDLDVPAYESPPPDPTAPPFPSHMMPMIQSFAVAARAPFAALLERISASYSRVVVVYDRLNSFAAAQAARLPNGEAFGLQCVAMSYNIGWLDPENRLVREHGLKFHPVEACMPKEFVEFISREEQDEENATSSGMLMNTSRAIEAEFIDEIAAHPMFKEMKLFAVGPLNPLLDATARTPGQTRHECMDWLDKQPAASVLYVSFGTTSSLRGDQVAELAAALKGSKQRFIWVLRDADRADIFADSGESRHAELLSRFTAETEGVGLVITGWAPQLEILAHGATAAFMSHCGWNSTMESLSHGKPILAWPMHSDQPWDAELVCKYLKAGLLVRPLEKHSEVVPAEAIQEVIEEAMLPEKGMAIRRRAMELGEVVRASVADGGSSRKDLDDFVGYITR

SEQ ID NO: 1612 - protein, 464 aa, Oryza sativa
MAEKGNPANKVAIVAVPFPAQGHLNQVLHLSLQLASSSHGLAVHYAAPAPQLRQARARVHGWDDKALLSVQFHDLGISTYVSPPPDPTADTPFPSHLMPLWEAYTADARAPLSALLDELSASHRRVVVVCDTINSFAVEEAARLPNGEAFPVSCVAVSALALHIDTGHRLLRENGLNHAPLETYMTQEFLDYASERARASESILSGAGILANASRALEGDFIDDLAETLAAGGKKLFAIGPLNPLLNTGSSEQGRRRHECLDWLDRQPPDSVLYVSFGTTCSLRVEQVAELAATLRGSKQRFIWVMRDADRGNIFTDTGEGETRHAKLLSEFSKQTEGTGMVITGWAPQLEILAHGATAAFMSHCGWNSTMESMSHGKPILAWPMHSDQPWDAELVCKYFKAGLLVRPWEKHGEVLPAATIQEVIKKMMASDEGLAVRQRAKALGDAVRSSRNDLEDFIAHITR

SEQ ID NO: 1613 - protein, 287 aa, Oryza sativa
MAAISSLPFAALRRAADCRPSTAAAAAGAGAGAVVLSVRPRRGSRSVVRCVATAGDVPPTVAETKMNFLKSYKRPILSIYSTVLQELLVQQHLMRYKTTYQYDAVFALGFVTVYDQLMEGYPSNEDRDAIFKAYITALNEDPEQYRADAQKMEEWARSQNGNSLVEFSSKDGEIEAILKDISERAQGKGSFSYSRFFAVGLFRLLELANATEPTILDKLCAALNINKRSVDRDLDVYRNILSKLVQAKELLKEYVEREKKKREERSETPKSNEAVTKFDGSLNSMRH

SEQ ID NO: 1614 - protein, 725 aa, Oryza sativa; identical to SEQ ID NO: 1246

SEQ ID NO: 1615 - protein, 214 aa, Oryza sativa; identical to SEQ ID NO: 1368

SEQ ID NO: 1616 - protein, 471 aa, Oryza sativa
MGAFLLFVCVLAPFLLVCAVRGRRRQAGSSEAAACGLPLPPGSMGWPYVGETFQLYSSKNPNVFFNKKRNKYGPIFKTHILGCPCVMVSSPEAARFVLVTQAHLFKPTFPASKERMLGPQAIFFQQGDYHAHLRRIVSRAFSPESIRASVPAIEAIALRSLHSWDGQFVNTFQEMKTYALNVALLSIFGEEEMRYIEELKQCYLTLEKGYNSMPVNLPGTLFHKAMKARKRLGAIVAHIISARRERQRGNDLLGSFVDGREALTDAQIADNVIGVIFAARDTTASVLTWMVKFLGDHPAVLKAVTEEQLQIAKEKEASGEPLSWADTRRMKMTSRVIQETMRVASILSFTFREAVEDVEYQGYLIPKGWKVLPLFRNIHHNPDHFPCPEKFDPSRFEVAPKPNTFMPFGNGTHSCPGNELAKLEMLVLFHHLATKYRWSTSKSESGVQFGPFALPLNGLPMSFTRKNTEQE

SEQ ID NO: 1617 - protein, 1042 aa, Oryza sativa
MAARAEAAAAAPRPLQAAAIGVCAETGFWDALRRLKLDVLGTDDSPIPITGYYTPRQYEKIASLFRICPESILPPSANSFGDRNNCPVPGTLLNTNNMRGFQNLDRALLLKAEAKKILHDIKSGKVEENPALLLRFLVISFADLKNWKVYYNVAFPSLIFDSKITLLSLKLASQVLKQEEATSLSNAFTEWRKSSETTVVPFFLINISPDSSATIRQLKDWKACQGNGQKLLFGFYDHGNRGFPGWALRNYIAFVSLRWKIEKVHFFCYREKRGRPDIQQSLVGEASFPAPHAGWDEPDYVPEAIGWEGETAGKESKEMKPKEIDLSSINPASQDEEKQLMHLKLMGWRHFPVNLDKLAGVRCLLLGAGTLGCEVARLLMTWGVRKLTVVDDGCVSMSDLVKQSLYTDKDCGVPRVTAIVPHLKERCSAVEVEGIQMGIPKLEYNISASKISSITDDCKRLQTLVDSNDVVFLLNETWEGMWLPTLLCADKNKIAITVLLGYDNYLVMRHGAGPGTKSGGMDEGIAQIENLSTQDALGRQRLGCCFCSDTTSLVNSDHNGALDQQSAVILPGLTSVASGKAVELFARMLHHPDEIHAPGDIAGTDTEHQLGLLPHQMQGSLSKCVLSTVLCNSSSNCIACSNAVLSEYRRRGFDFVTQAITCPTYLKDLTGISDLKKPFASKISASIPVSKTSASIPVNLEKLSSARCLLLGAGTLGCDVARILMDCGVRKLTVVDSGRVVVSNLARQSLYTSDDRDSPKASAILGRLKERCPSVDAKGIKMEIPMPGHPVSPNEAVSVLEDCKRLQELVSSHDAVFLLTDTRESRWLPTLLCANENKIAITAALGYDSYLVMRHGAGPGTNCGSPDVVAAADTLSAEDVLGRQRLGCYFCNDVVAPVDSVSNRTLDQQCTVTRPGLSSITSGCAADLFTRMLHHPDGIHAPGEIAGTSSEGPLGLLPHQIRGSLSQYNLLTLLGYSSSNCTACSNAVLSEYHRRGMDFVMQVINEPTYLEDLTGLTDLMKSAAYSQVEWIDEVDDDDEMDI

SEQ ID NO: 1618 - protein, 318 aa, Oryza sativa; identical to SEQ ID NO: 1332

SEQ ID NO: 1619 - protein, 608 aa, Oryza sativa
MATITTPGYAHIQRQHGRCSTTAGRRGASNSVRFSARAVSSVPHAAAASSAPAFLPVPFVPGADAPSPSGKSAIGVPKAPRKGEEGKRLNFFQRAAAMALDAFEEGFVANVLERPHGLPSTADPAVQIAGNFAPVGETPPARALPVSGRIPPFINGVYARNGANPHFDPVAGHHLFDGDGMVHAVRIRNGAAESYACRFTETARLRQERAMGRPMFPKAIGELHGHSGIARLALFYARAACGLLDPSHGTGVANAGLIYFNGRLLAMSEDDLPYQVRVTADGDLETVGRYDFDGQLGCAMIAHPKLDPATGELHALSYDVIKKPYLKYFYFAPDGTKSADVEIPLDQPTMIHDFAITENYVVVPDHQVVFKLQEMLRGGSPVVLDKEKTSRFGVLPKHAADASEMVWVDVPDCFCFHLWNAWEEADTDEVVVIGSCMTPADSIFNESDDRLESVLTEIRLNTRTGESTRRAILPPSSQVNLEVGMVNRNLLGRKTRYAYLAVAEPWPKVSGFAKVDLATGELTKFEYGEGRFGGEPCFVPMDAAAATPRGEDDGYILSFVHDERAGTSELLVVNAADMRLEATVQLPSRVPYGFHGTFITGDELTTQA

SEQ ID NO: 1620 - protein, 608 aa, Oryza sativa; identical to SEQ ID NO: 1619

SEQ ID NO: 1621 - protein, 659 aa, Oryza sativa
MALLSATAPAKTRFSLFSHEEAQHPHPHALSACCGGGASGKRQRARARVAAAMRPADAAASVAQAASPGGGGEGTRRPRVLVAGGGIGGLVLALAARRKGYEVTVFERDMSAVRGEGQYRGPIQIQSNALAALEAIDMSVAEEVMREGCVTGDRINGLVDGISGSWYIKFDTFTPAAERGLPVTRVISRMTLQQILARAVGDDAILNDSHVVDFIDDGNKVTAILEDGRKFEGDLLVGADGIWSKVRKVLFGQSEATYSEYTCYTGIADFVPPDIDTVGYRVFLGHKQYFVSSDVGAGKMQWYAFHKEPAGGTDPENGKNKRLLEIFNGWCDNVVDLINATDEEAILRRDIYDRPPTFNWGKGRVTLLGDSVHAMQPNLGQGGCMAIEDGYQLAVELEKSWQESAKSGTPMDIVSSLRRYEKERILRVSVIHGLARMAAIMATTYRPYLGVGLGPLSFLTKLRIPHPGRVGGRFFIKYGMPLMLSWVLGGNSTKLEGRPLSCRLSDKANDQLRRWFEDDDALEQAMGGEWYLLPTSSGDSQPIRLIRDEKKSLSIGSRSDPSNSTASLALPLPQISENHATITCKNKAFYVTDNGSEHGTWITDNEGRRYRVPPNFPVRFHPSDAIEFGSDKKAVFRVKVLSTLPYESARGGPQILQAA

SEQ ID NO: 1622 - protein, 869 aa, Oryza sativa
MQKLGLSGLRGLEGFRSLAGSTSTAAKAPNPKPSSDIGGSTYGSFANLKITAEKLVKEQASVKTDLEMTHTKLRRATEQINLLEAKLQQAVNENAKLKVKQTEDSKLWQGLDSKVSSTKTLCNQLTETLQQLASQTERAEEDKKFFEEILGKNSKAFEEFNCLLHDSSIKLECAEQMIISGKQEMLRIKQEKEEMDQSYKEQLYASDTTIREKNSLIKQLEDSIEQNKARLLYVDSRLECMEQELKLKEDVCICLKENLASTESEKNDLKLRNEGYTLEVQKLSKDNKELNELLSGFTVKVTELDKEHTSISSHVTQLISSFERYDGKVHEEKMLMIKSAKDKFEHLQNQYVNLISENNALQTEIEELKSRIIELQKTQEIVMVQHVEECQVAEDKIRRLESEAEISASNISQLEKVASDLEGRVQKLLEDSRSAENHKQELLQKILKLESDNQELLGRVQSVLNEKSNDTESLQGEIAKRDQQVETLENQVNQLCSIIDEKEQLHTCAVEREKNLEEQKLQVQASLAATESQLTEAKKQYDIMLEGKKIELSKHLKELSLKNDQAINEIRRKYELEKVEIINIEKEKAEKLIKEMENKCNEKISENRQDSERYLMCLKEEHGSMVARIQQDNEHKESTLRAYHKEELQRIQSQAENELRERLSSLRKDHEIQMKSLTKKHEENCQKLQDELELQKSKEEKQRALLQLQWKVMGETQQVDQEVNSKKEYSVSSIKRRDPYIRKEHQLQLVSPETKRKDVNLSGIIQSPITNMLRKVEKGTQDIPKHRKVTHHEYEVETANGRITKRRKTKSTVMFGEPNTQKSLHDTADKDPTKMKKVVAGSHPHPANIGELFSEGSLNPYAEDPYAFG

SEQ ID NO: 1623 - protein, 490 aa, Oryza sativa
MAGGGGKSVAAALAMACFLLILAAFAPPAAAAPPDIMSIIRYNAEHGVRGLERTEAEARAAYDLWLARHRRGGGGGSRNGFIGEHERRFRVFWDNLKFVDAHNARADERGGFRLGMNRFADLTNGEFRATYLGTTPAGRGRRVGEAYRHDGVEALPDSVDWRDKGAVVAPVKNQGQCGSCWAFSAVAAVEGINKIVTGELVSLSEQELVECARNGQNSGCNGGIMDDAFAFIARNGGLDTEEDYPYTAMDGKCNLAKRSRKVVSIDGFEDVPENDELSLQKAVAHQPVSVAIDAGGREFQLYDSGVFTGRCGTNLDHGVVAVGYGTDAATGAAYWTVRNSWGPDWGENGYIRMERNVTARTGKCGIAMMASYPIKKGPNPKPSPPSPAPSPPQQCDRYSKCPAGTTCCCNYGIRNHCIVWGCCPVEGATCCKDHSTCCPKEYPVCNAKARTCSKSKNSPYNIRTPAAMARSVPEQPDSISFVVLNREDLV

SEQ ID NO: 1624 - protein, 234 aa, Oryza sativa
MPRRARARGGGGGGGEEVKVEDDFIDSVLNFGGGGGGEEDGDDGEEEQQQQQAAAAAMGKEFKSKNLEAERRRRGRLNGNIFALRAVVPKITKMSKEATLSDAIEHIKNLQNEVLELQRQLGDSPGEAWEKQCSASCSESFVPTENAHYQGQVELISLGSCKYNLKIFWTKRAGLFTKVLEALCSYKVQVLSLNTISFYGYAESFFTIEVKGEQDVVMVELRSLLSSIVEVPSI

SEQ ID NO: 1625 - protein, 254 aa, Oryza sativa; identical to SEQ ID NO: 1261

SEQ ID NO: 1626 - protein, 1011 aa, Oryza sativa; identical to SEQ ID NO: 1264

SEQ ID NO: 1627 - protein, 343 aa, Oryza sativa; identical to SEQ ID NO: 1493

SEQ ID NO: 1628 - protein, 509 aa, Oryza sativa
MGSFARKEHQFLAELGLAPRNPGSFACGAWGGSGPVVTSTNPTNNQVIAEVVEASAREYEEGMRACYDAAKTWMAIPAPKRGEIVRQIGDALRAKLHHLGRLVSLEMGKILPEGIGEVQEIIDMCDYAVGLSRQLNGSIIPSERPNHMMMEVWNPLGVVGVITAFNFPCAVLGWNACIALVCGNCVVWKGAPTTPLITIAMTKIVASVLERNNLPGSIFTAFCGGADIGQAISLDTRIPLVSFTGSTKVGLMVQQQVNARFGKCLLELSGNNAIIVMDDADIQLAVRSVLFAAVGTAGQRCTTCRRLLLHESIYRTFLDQLVEVYKQVRIGDPLENGTLLGPLHTPASRDAFLKGIQTIRSQGGKILYGGSAIESEGNFVQPTIVEISPSAPVVREELFGPVLYVMKVQNLKEAVEINNSVPQGLSSSIFTKRPDIIFKWIGPHGSDCGIVNVNIPTNGAEIGGAFGGEKATGGGREAGSDSWKQYMRRATCTINYGSELPLAQGINFG

SEQ ID NO: 1629 - protein, 398 aa, Oryza sativa
MAAAVTVEEVRRAQRAEGPATVLAIGTATPANCVYQADYPDYYFRITKSEHMVELKEKFKRMCDKSQIRKRYMHLTEEILQENPNMCAYMAPSLDARQDIVVVEVPKLGKAAAQKAIKEWGQPRSRITHLVFCTTSGVDMPGADYQLAKMLGLRPNVNRLMMYQQGCFAGGTVLRVAKDLAENNRGARVLAVCSEITAVTFRGPSESHLDSMVGQALFGDGAAAVIVGSDPDEAVERPLFQMVSASQTILPDSEGAIDGHLREVGLTFHLLKDVPGLISKNIERALGDAFTPLGISDWNSIFWVAHPGGPAILDQVEAKVGLDKERMRATRHVLSEYGNMSSACVLFILDEMRKRSAEDGHATTGEGMDWGVLFGFGPGLTVETVVLHSVPITAGAAA

SEQ ID NO: 1630 - protein, 278 aa, Oryza sativa
MPGAVKVFGSPSSAEVARVLACLFEKDVEFQLIRVDSFRGSKRMPQYLKLQPHGEALTFEDGNVTLVESRKIIRHIADKYKNQGNPDLIGMGALERSSIEQWLQTEAQSFDVPSADVVYSLAYLPAATTQPNKGAAAADGGRCEEEKNDDGGRDRQYSSQRQGGAGAGGGRDGQMAAAHRQKVEEMKQLFEKSSKELSKVLDIYEQRLEEAEYLAGDKFTLADLSHLPNADRLAADPRTLRMLQSRRNVSRWWADVSGRESWKQVKSLNRPPSAEAPF

SEQ ID NO: 1631 - protein, 147 aa, Oryza sativa; identical to SEQ ID NO: 1518

SEQ ID NO: 1632 - protein, 237 aa, Oryza sativa
MVMNPDAVRNVVGIIGNLISFGLFLSPLPTFVTIVKKKDVEEFVPDPYLATFLNCALWVFYGLPFIHPNSILVVTINGTGLLIEIAYLAIYFAYAPKPKRCRMLGVLTVELVFLAAVAAGVLLGAHTYDKRSLIVGTLCVFFGTLMYAAPLTIMKQVIATKSVEYMPFTLSLVSFINGICWTIYAFIRFDILITIPNGMGTLLGAAQLILYFCYYDGSTAKNKGALELPKDGDSSAV

SEQ ID NO: 1633 - protein, 136 aa, Oryza sativa; identical to SEQ ID NO: 1288

SEQ ID NO: 1634 - protein, 392 aa, Oryza sativa; identical to SEQ ID NO: 1093

SEQ ID NO: 1635 - protein, 251 aa, Oryza sativa; identical to SEQ ID NO: 987

SEQ ID NO: 1636 - protein, 235 aa, Oryza sativa; identical to SEQ ID NO: 933

SEQ ID NO: 1637 - protein, 402 aa, Oryza sativa; identical to SEQ ID NO: 1140

SEQ ID NO: 1638 - protein, 373 aa, Oryza sativa; identical to SEQ ID NO: 1314

SEQ ID NO: 1639 - protein, 877 aa, Oryza sativa; identical to SEQ ID NO: 1388

SEQ ID NO: 1640 - protein, 922 aa, Oryza sativa
MLTATQTLAPAVLSRSHGAPSSFSSQPRRTAAAASRVSCTRVGALSEVVNGELVVGDQEQTTDDLLTRHKNVVADYTLSATVTVSLKQDDSTPQKVADMVNRDWLFLDFFSSHIEGMHTEPQLARYSHMDGKGSFIYEASFSIPSSLDAVGAVQVVNRYSSEVYISDIDVHLCGGRHQWTDITFHCNSWIDYNPNDQRFFFPLKSYLPSQTPRGVKNLRKEELRAIRGDGRGERKEWERIYDYDVYNDLGDPDNDPATRRPVLGGRGRPYPRRCRTGRRRCRTDPSSESPPAKDGAGIYVPRDEAFTERKAGAFATKKALSALSAFTTAQRVSGDRRRGFPSLAAIDALYEDGYKNRPSSSQQEADNLEGYFREVLQKQVKLLLKGEKEEFKEELRKVFKFQTPEIHDKDKLAWFRDEEFARQTLAGMNPLSIQLVRDTDFPIFSKLDEETYGPGDSLITKELIEEQINGVMTAEEAVEKKKLFMLDYHDVLLPFVHAVRELDDTTLYASRTLFFLTEDGTLRPIAIELTRPKSPNTPQWRQVFTPGSSVAASWLWQLAKTHVLAHDTGYHQLVSHWLRTHCCVEPYVIAANRRLSQMHPIYRLLHPHFRFTMEINAQARGMLINANGIIESAFAPGKLCMELSSAVYDKFWRFDMEALPADLIRRGMAIECEDGKLELTIEDYPYANDGLLIWDSIKEWVSDYVNHYYQLASDIHMDKELQGWWNEVRTKGHPDKEEGWPELNCHGSLVEVLTTIIWVASGHHAAVNFGQYPYAGYFPNRPTIARRNMPTEGQACSHDGMQPTFVEDPVRVLLDTFPSQYQTTLVLPVLNLLSSHSPGEEYMGTHAESAWMADREVRAAFGRFNERMMSIAEMIDCRNKDPERKNRQGPGVVPYVLLKPSYGDPKDMTSVMEMGIPNSISI

SEQ ID NO: 1641 - protein, 242 aa, Oryza sativa; identical to SEQ ID NO: 1319

SEQ ID NO: 1642 - protein, 532 aa, Oryza sativa
MAAIYLLIAALIASSHALAAHGAGGGVPLAAAAPLPFPGDLAASGKLRTDPNATVPASMDFGNITAALPAAVLFPGSPGDVAELLRAAYAAPGRPFTVSFRGRGHSTMGQALAAGGVVVHMQSMGGGGAPRINVSADGAYVDAGGEQLWVDVLRAALARGVAPRSWTDYLHLTVGGTLSNAGVSGQTYRHGPQISNVLELDVITGHGETVTCSKAVNSDLFDAVLGGLGQFGVITRARVAVEPAPARARWVRLVYADFAAFSADQERLVAARPDGSHGPWSYVEGAVYLAGRGLAVALKSSGGFFSDADAARVVALAAARNATAVYSIEATLNYAANATPSSVDAAVAAALGDLHFEEGFSFSRDVTYEEFLDRVYGEEEALEKAGLWRVPHPWLNLFVPGSRIADFDRGVFKGILQTATDIAGPLIIYPVNKSKWDAAMSAVTPEGEEEVFYVVSLLFSAVANDVAALEAQNRRILRFCDLAGIGYKAYLAHYDSRGDWVRHFGAKWDRFVQRKDKYDPKKLLSPGQDIFN

SEQ ID NO: 1643 - protein, 386 aa, Oryza sativa
MMMMGEGVSSVPPWSHLPVSGVDVLGGGGGGGDEMTPYVIAALRDYLPANDVGVGADEEEEAAAMAAAVDAYACDEFRMYEFKVRRCARGRSHDWTECPFAHPGEKARRRDPRKYHYSGTACPDFRKGGCKRGDACEYAHGVFECWLHPARYRTQPCKDGTACRRRVCFFAHTPDQLRVLPAQQSSPRSVASSPLAESYDGSPLRRQAFESYLTKTIMSSSPTSTLMSPPKSPPSESPPLSPDGAAAIRRGSWPGVGSPVNDVLASFRQLRLNKVKSSPSGGWSYPSSSAVYGSPKAATGLYSLPTTPLASTATVTTASSFMPNLEPLDLGLIGDEEPVQRVESGRALREKVFERLSRDGAISGDATAFATAGVGLDVDWVSDLIN

SEQ ID NO: 1644 - protein, 1048 aa, Oryza sativa
MEGEREGVVAKNEDNAGGGGGGLGTGGNGGGGGGGSANGRRRWRGGGSSGYRQHPIIQAYPALLPLPINGATGHAHINGAVSLPLPLPPPVLLYLQPPPPPPLLPLLPKVAAATFYGKPPKAADAAPRGSMWKHRPSKKPPPHAITAALLPLPRDGKALQEKIFFANERKTSEKEVNHVDTHEKFTVAPLDNAIARRPDMGGVEGAEIPLSANHFLVQFDPGQKIFHYNVDISPRPSKETARMIKKKLVEENPSVLSGSQPAFDGRKNLYSPVRFQEDRVEFFVSLPVALARCSVVKEDTGHMLDKQKLKTFKVNVRLVSKLCGEDLNKYLNEDKDGIPLPQDYLHALDVVLREGAMESSILVGRSLYARSMGEARDIGGGAVGLRGFFQRLRPTKQGLALNVDLSLSAFHESTGIISYLQKRCDFLKDLPQKKTRALAEEEHREVEKALKNIRVFVCHRETNQRYHVHSLTKETTENLKFRDRSGKDLMVVDYFKEHYNHDIQFRNLPCLQIGRSKPCYVPMELCVVCEGQKFLGKLSDEQTSKILKMGCERPSERKGIIKGVVKGAFHARSDTYADQFSLQVSKHMTKLSGRVLLPPKLKLGSSGRIKDITPDRFDRQWSFLDSHVAEGSKIKSWALISFGGTPEQHFCITKFVNQLSNRCEQLGILLNKKTIISPIFERIQLLNNVGILEGKLKKIQEAASGNLQLLICVMERRHQGYADLKRIAETSIGVVTQCCLYSNLSKLTSQFLTNLALKINAKLGGCNIALYSSFPCQIPRIFLSEEPVMFMGADVTHPHPLDDSSPSVVAVVASMNWPSANKYISRMRSQTHRKEIIEQLDVMAGELLEEFLKEVGKLPSRIIFFRDGVSETQFYKVLKEEMHAVRTTCSRYPGYKPLITFIVVQKRHHTRLFHRERNGSSSHYSDQNIPPGTVVDTVITHPREFDFYLCSHWGTKGTSRPTHYHVLWDENNFRSDEVQQLIHNLCYTFARCTRPVSLVPPAYYAHLAAYRGRLYLERSDTTMYRVSPLQTVPLPKLRDNVKRLMFYC

SEQ ID NO: 1645 - protein, 855 aa, Oryza sativa
MAAAAVGGRGERLSSSSPTAAAPQVDAGKYVRYTPEQVEALERVYTECPKPSSLRRQQLIRECPILSNIEPKQIKVWFQNRRCREKQRKEASRLQTVNRKLNAMNKLLMEENDRLQKQVSRLVYENGYMRTQLHNPSAATTDTSCESVVTSGQHHQQQNPAVLHPQRDANNPAGLLAIAEETLAEFMSKATGTAVEWVQMVGMKPGPDSIGIIAVSHNCSGVAARACGLVSLEPTKVAEILKDRPSWYRDCRCVDIIHVIPTGNGGTIELIYMQTYAPTTLAAPRDFWTLRYTSGLEDGSLVICERSLTQSTGGPSGPNTPNFIRAEVLPSGYLIRPCEGGGSMIYIVDHVDLDAWSVPEVLRPLYESPKILAQKMTIAALRHIRQIAHESSGEIPYGAGRQPAVFRTFSQRLSRGFNDAVSGFPDDGWSLLSSDGSEDITISVNSSPNKLVGSHVSPNPLFSTVGGGILCAKASMLLQNVPPALLVRFLREHRSEWADPGVDAYSAASLRASPYAVPGLRTSGFMGSQVILPLAHTLEHEEFLEVIRLEGHGFSHDEVLLSRDMYLLQLCSGVDENATSASAQLVFAPIDESFADDAPLLPSGFRVIPLDTKMDGPSATRTLDLASALEVGPGGASRASVEASGTCNRSVLTIAFQFSYENHLRESVAAMARSYVRAVMASVQRVAVAIAPSRLGPQIGMKHPPASPEALTLASWIGRSYRAHTGADIRWSDTEDADSPLALLWKHSDAILCCSLKPAPMFTFANNAGLDILETTLVNLQDISLEMILDDEGRKALCSEFPKIMQQGFTYLPGGVCKSSMGRQASYEQAVAWKVLSDDDAPHCLAFMLVNWTFM

SEQ ID NO: 1646 - protein, 486 aa, Oryza sativa
MEVVSSSHSCLAFNRTPSSAWRFPGNGLGPGHAKLTRPRSAILCVRSGTASNPADSGKVHASHGFYVSDVDAALQGIPKKVGEIEKMIIPSLPEGPESSLISTGFWEWKPKLSVYYEKSGIDNSKAPSVLFLPGFGVGTFHFEKQLKDLGRDYKVWTMDFLGQGMSLPCEDPAPKSTSGELDEDTYWGFGQELQPWAEELVYSIDLWRDQVQHFIEEVIGEPVYIVGNSLGGFVSLYLAASCPHLVKGVTLLNATPFWGFLPNPATSPRLSKIFPWAGTFPLPSFVRKLTETVWQKISDPRSIQGILKQVYADHSTNVDMVFSRIIETTQHPAAAASFASIMCAPKGQISFEEALSRCQRQGIPISLMYGREDPWVRPIWGIKVKQQVPESPYYEISPAGHCPHDEVPEVINYLLRGWLKNVESEGSVAVPFLEEPSYAENGVSRELEFVRGGSKKSVHVRLFGSKISLWSQLRSLLKSNTWVISR

SEQ ID NO: 1647 - protein, 250 aa, Oryza sativa; identical to SEQ ID NO: 986

SEQ ID NO: 1648 - protein, 147 aa, Oryza sativa
MAAAALTSQLNALVNNMFAMGLLDDQFQQLQMLQDSTAPDFVSEVVTLFCDDGERIICELSRQLEKPNVDFDRVDSYVHQLKGSSASVGAQKVKNTCIQFREFCQQRSRDGCLKTLDLVRTEFYDLRNKFQAMLQLEQQIQACYPKH

SEQ ID NO: 1649 - protein, 338 aa, Oryza sativa; identical to SEQ ID NO: 932

SEQ ID NO: 1650 - protein, 609 aa, Oryza sativa; identical to SEQ ID NO: 1333

SEQ ID NO: 1651 - protein, 345 aa, Oryza sativa
MARPRLLLLPLLAVAAAVLSSPLGRALAKTAKKSNDIVNGPLLTSKINAKRTLIVGPEDEFKTVQSAIDAVPVGNTEWVIVHLRSGIYREKVMIPETKPFIFVRGNGKGRTSINHESASSHNAESAAFTVHADNVIVFGLSIRNSARAGLPNVPEVRTVAAMVGGDKIAFYHCAFYSPHHTLFDVAGRHYYESCYIQGNIDFIFGGGQSIFQCPEIFVKPDRRTEIKGSITAQNRKQEDGSGFVFIKGKVYGVGQVYLGRANEAYSRVIFADTYLSKTINPAGWTSYGYTGSTDHVMLGEFNCTGPGSEATKREPWSRQLTQEEADKFINIDFINGKEWLPAYYY

SEQ ID NO: 1652 - protein, 257 aa, Oryza sativa; identical to SEQ ID NO: 949

SEQ ID NO: 1653 - protein, 428 aa, Oryza sativa; identical to SEQ ID NO: 953

SEQ ID NO: 1654 - RNA, 36 nt, Artificial Sequence
  Description of Artificial Sequence: Synthetic construct
gcacuugaucaccuucccugguuuuagagcuaugcu

SEQ ID NO: 1655 - RNA, 36 nt, Artificial Sequence
  Description of Artificial Sequence: Synthetic construct
uccaccuccucgaucaccagguuuuagagcuaugcu

SEQ ID NO: 1656 - RNA, 36 nt, Artificial Sequence
  Description of Artificial Sequence: Synthetic construct
ggccucccagaaguagacguguuuuagagcuaugcu

SEQ ID NO: 1657 - RNA, 36 nt, Artificial Sequence
  Description of Artificial Sequence: Synthetic construct
gggaaggugaucaagugcaaguuuuagagcuaugcu

SEQ ID NO: 1658 - RNA, 36 nt, Artificial Sequence
  Description of Artificial Sequence: Synthetic construct
gccaccgucgaacccuuuggguuuuagagcuaugcu

SEQ ID NO: 1659 - RNA, 36 nt, Artificial Sequence
  Description of Artificial Sequence: Synthetic construct
guaaaugggcuucccguugaguuuuagagcuaugcu

SEQ ID NO: 1660 - RNA, 36 nt, Artificial Sequence
  Description of Artificial Sequence: Synthetic construct
gacagacucccguguucccuguuuuagagcuaugcu

SEQ ID NO: 1661 - RNA, 36 nt, Artificial Sequence
  Description of Artificial Sequence: Synthetic construct
gugaauucaggagcuggaggguuuuagagcuaugcu

SEQ ID NO: 1662 - RNA, 36 nt, Artificial Sequence
  Description of Artificial Sequence: Synthetic construct
guacuugcugagaugaccaaguuuuagagcuaugcu

SEQ ID NO: 1663 - RNA, 36 nt, Artificial Sequence
  Description of Artificial Sequence: Synthetic construct
gcaacaugugugaucugcucguuuuagagcuaugcu

SEQ ID NO: 1664 - RNA, 36 nt, Artificial Sequence
  Description of Artificial Sequence: Synthetic construct
uggccgggaggauucccaugguuuuagagcuaugcu

SEQ ID NO: 1665 - RNA, 36 nt, Artificial Sequence
  Description of Artificial Sequence: Synthetic construct
augguucaugcagugcacggguuuuagagcuaugcu

SEQ ID NO: 1666 - RNA, 36 nt, Artificial Sequence
  Description of Artificial Sequence: Synthetic construct
gcucgaggacgaacucggugguuuuagagcuaugcu

SEQ ID NO: 1667 - RNA, 36 nt, Artificial Sequence
  Description of Artificial Sequence: Synthetic construct
auguacuggagggagcugggguuuuagagcuaugcu

SEQ ID NO: 1668 - RNA, 36 nt, Artificial Sequence
  Description of Artificial Sequence: Synthetic construct
uagaauguauaauuacccguguuuuagagcuaugcu

SEQ ID NO: 1669 - RNA, 36 nt, Artificial Sequence
  Description of Artificial Sequence: Synthetic construct
cgggccucccgggagccaucguuuuagagcuaugcu

SEQ ID NO: 1670 - RNA, 36 nt, Artificial Sequence
  Description of Artificial Sequence: Synthetic construct
caagcaccuggggcgucugcguuuuagagcuaugcu

SEQ ID NO: 1671 - RNA, 36 nt, Artificial Sequence
  Description of Artificial Sequence: Synthetic construct
gagaucagaucuugccgaugguuuuagagcuaugcu

SEQ ID NO: 1672 - RNA, 36 nt, Artificial Sequence
  Description of Artificial Sequence: Synthetic construct
gaaggugaucuugcuauugaguuuuagagcuaugcu

SEQ ID NO: 1673 - RNA, 36 nt, Artificial Sequence
  Description of Artificial Sequence: Synthetic construct
gaagaugagugagcuugcguguuuuagagcuaugcu

SEQ ID NO: 1674 - DNA, 346 bp, Oryza sativa
aagcggaggtccggaggaggaagcggcgagagaagctcagctaggcagggcgacgggcagaaacgcgaccacggcaacaaaccccgccgcgcgcgcccaccgtgccggttacatgggagtagaggcgggcggcggctgcggtgggagggcggtagtcaccggattctacgtctggggctgggagttcctcaccgccctcctgctcttctcggccaccacctcctactagctatacacacccatctcaccataacacacatacatagatagatagatagatagatacatacacacaaacataagtagctaggtagagaaagagatcatagcgttaggtgatcgatcg

SEQ ID NO: 1675 - DNA, 117 bp, Oryza sativa; identical to SEQ ID NO: 190

SEQ ID NO: 1676 - DNA, 89 bp, Oryza sativa
gaggcctcctcctcgcctcgcctcgccacgccgcgccgcgacgcgacgcgccgtggtcagctggtcgccggtgcgggtgcgggtgcgca

SEQ ID NO: 1677 - DNA, 15 bp, Artificial Sequence
  Description of Artificial Sequence: Synthetic construct
aaaaaaaaaaaaaaa

SEQ ID NO: 1678 - DNA, 25 bp, Artificial Sequence
  Description of Artificial Sequence: Synthetic construct
cacatacacacaaaaataaaaaaga

SEQ ID NO: 1679 - DNA, 325 bp, Oryza sativa
caaacgccaaaacgccacggaaacaaatcaacaatttcctctcctgtcaatgaacttgtgtgcacgacaactcatctgacagtgatccatcgtcctttttctttgactcgatgactttgtgagagatgttttatgccgattttatctactaaagtacttactaatcctgcggttgatccatcgccgcgcggttcacgcgccaaatgacgagtcgaaatgtatgcgtagtttgaccacatgcatagctcactggagaagctattagctatatataccgctgcaatgctcgctagcttagctaagcaactgcaagtgaagcggcgac

SEQ ID NO: 1680 - DNA, 300 bp, Oryza sativa
tgtgaaggttctgtagtcgtcctcttgtgtttaatcttgttttctgaaatcatgaagtcttccgcgtcttgttctgatccatgagtatgtactgaggtttatgggtggagtgagggcgattcgtactatttctaatatgtgcatcaaactgtaggcgctagagtagtcgattgctatggttttctgttcctagttgatcattgttccaagtatagaagttttgatgttaaattgatgttgcaaatacagtgcttattgattggattgccaatttatcatcggtttgctcaatgaatccag

SEQ ID NO: 1681 - RNA, 36 nt, Artificial Sequence
  Description of Artificial Sequence: Synthetic construct
aaaacaagauuaaacacaagguuuuagagcuaugcu

SEQ ID NO: 1682 - RNA, 36 nt, Artificial Sequence
  Description of Artificial Sequence: Synthetic construct
ugauccaugaguauguacugguuuuagagcuaugcu

SEQ ID NO: 1683 - RNA, 36 nt, Artificial Sequence
  Description of Artificial Sequence: Synthetic construct
acuuggaacaaugaucaacuguuuuagagcuaugcu

SEQ ID NO: 1684 - DNA, 300 bp, Oryza sativa
ataaaaaaaactctctaaaaatttctatgtttttctccaaatgaaaggcactaaatagagcaatttctgcagaaaccacatgttcttgccgtttcccatcccagctggaagcacaaaaataaccgtttctgttttggcacgagaaaaaagtttcgtccacccatcatccaataggcggccattatgtagccacgtgtcatccaaatttgcaactaggaggcagaggctacgcagcgcgcaggatctgaaactgcaaaaagaaaaaagaaaaaaaaaacttccccatctttctagcagctc

SEQ ID NO: 1685 - RNA, 36 nt, Artificial Sequence
  Description of Artificial Sequence: Synthetic construct
uauguuuuucuccaaaugaaguuuuagagcuaugcu

SEQ ID NO: 1686 - RNA, 36 nt, Artificial Sequence
  Description of Artificial Sequence: Synthetic construct
gccgccuauuggaugaugggguuuuagagcuaugcu

SEQ ID NO: 1687 - RNA, 36 nt, Artificial Sequence
  Description of Artificial Sequence: Synthetic construct
cauccaaauuugcaacuaggguuuuagagcuaugcu

SEQ ID NO: 1688 - DNA, 400 bp, Oryza sativa
aggcggttaccccgcgttgcgcgcgtagacgtacagggcgagccctacaggccccgggacggtggtgggacggatcgacacggcgcgacgcacacgcacgcaaaccaaatcttttcggaccaactcctcccccccacgaatattaatcatttctaagcgtatttattgtcctgcgaagtttttgttttattttatttttgaaaaaagagagagagagagagagagcaaaaggtgaccaccaagagaaagaccggagtcaccagcactgaccaccaagaccgtcacgggagcgagaggggacggccatgggtgggtgggcccggctcccggctccgtgcaggcagggccgcagcgcagggggagtcgagtctatttaaggcccccctcctctcgccccctc

SEQ ID NO: 1689 - RNA, 36 nt, Artificial Sequence
  Description of Artificial Sequence: Synthetic construct
gaaaugauuaauauucguggguuuuagagcuaugcu

SEQ ID NO: 1690 - RNA, 36 nt, Artificial Sequence
  Description of Artificial Sequence: Synthetic construct
acugaccaccaagaccgucaguuuuagagcuaugcu

SEQ ID NO: 1691 - RNA, 36 nt, Artificial Sequence
  Description of Artificial Sequence: Synthetic construct
acucgacucccccugcgcugguuuuagagcuaugcu

SEQ ID NO: 1692 - DNA, 300 bp, Oryza sativa
gcatacatagcccgcgcgcggcgtgcgtgcgcagggcagctaccacagctagctagccgaacgatcgatcgatcggcgcggcgcgcgcgcagacgccgtcacgcacgcacgcacggacgcgcacgcgcacgcgcgcgcccacgtcctgggagcggccggcgcggcgcggcagcccagagcgcgcgctatagtagctagcgttgtcggcgccgtagccggtgtacaagtctctcgtgcgcgccgcggccgtatggctcggctctgtggctgtggctggctggcgtcccgcggggcaatgcg

SEQ ID NO: 1693 - RNA, 36 nt, Artificial Sequence
  Description of Artificial Sequence: Synthetic construct
guccgugcgugcgugcgugaguuuuagagcuaugcu

SEQ ID NO: 1694 - DNA, 218 bp, Oryza sativa
cccgcgcgcggcgtgcgtgcgcagggcagctaccacagctagctagccgaacgatcgatcgatcggcgcggcgcgcgcgcagacgccgtcacgcacgcacgcacggacgcgcacgcacgcacggacgcgcacgcgcacgcgcgcgcccacgtcctgggagcggccggcgcggcgcggcagcccagagcgcgcgctatagtagctagcgttgtcggcgc

SEQ ID NO: 1695 - RNA, 36 nt, Artificial Sequence
  Description of Artificial Sequence: Synthetic construct
cgccgucacgcacgcacgcaguuuuagagcuaugcu

SEQ ID NO: 1696 - RNA, 20 nt, Artificial Sequence
  Description of Artificial Sequence: Synthetic construct
uuagaugaccaucagcaaac

SEQ ID NO: 1697 - DNA, 446 bp, Oryza sativa
acccctccctcagcttcccttcccatctgcccgtcttcttcttcttcctcctcctcctgccctacccgcggccgcgcgatataaatacatcaccctccccatccgcctctccgccagcaaaccagcacagccgtacgccgccggcaactgcgttcgcgcgagcgcctgtccgcgttgtacatatttgtgagtaatccgtcacctctgtacgcagcacgcacatgccgccgccaaagcgcagatgattccagtctttccctacttttgaatctgtgcctgatgaatctgcgtcgtcgtgctgtagcactagcgagtgtttcccttgcgacgtagagtttgctgatgttcatctaattagcccggaggactcgggaatcagaattcaccgtggtgtcagggagaaaaagtggatcgaacttcggatcacctggtaccatttgtttacg

SEQ ID NO: 1698 - RNA, 36 nt, Artificial Sequence
  Description of Artificial Sequence: Synthetic construct
cagcaaacucuacgucgcaaguuuuagagcuaugcu

SEQ ID NO: 1699 - RNA, 36 nt, Artificial Sequence
  Description of Artificial Sequence: Synthetic construct
ucgggaaucagaauucaccgguuuuagagcuaugcu

SEQ ID NO: 1700 - DNA, 300 bp, Oryza sativa
ttaggcgtttaatgtagataagctagctagggagatatttttctttctttcattgcccttctatttcctcaagggaagtccggggagaaaaaatggagttttcttcttttttaacttgatcataagaaggtaatgatgatgagaatgggttctcggaggaaaaacaaatgataatgtgtaatatcattgacattgacccaaattaaatggcttcagcagttaatgctgctgcatttcggctccctttcattacaccaaggcaccaacgcgtgttgccatatgcgttttccccgtacacgg

SEQ ID NO: 1701 - RNA, 36 nt, Artificial Sequence
  Description of Artificial Sequence: Synthetic construct
uaauguagauaagcuagcuaguuuuagagcuaugcu

SEQ ID NO: 1702 - RNA, 36 nt, Artificial Sequence
  Description of Artificial Sequence: Synthetic construct
auuuccucaagggaaguccgguuuuagagcuaugcu

SEQ ID NO: 1703 - RNA, 36 nt, Artificial Sequence
  Description of Artificial Sequence: Synthetic construct
ugaugagaauggguucucggguuuuagagcuaugcu

SEQ ID NO: 1704 - DNA, 216 bp, Oryza sativa
gtttggtctctggtgaggcgttttgatcagccacagcttttcaagccatttgtgagccggtgtgagatgaaagggaacattgagattggcagtgtaagggaggttaatgttaagtctggcctgcctgccacaagaagcactgagaggctggagctgttagatgacaatgagcacatactcagtgtcaggttcgtgggaggtgatcataggctcaag

SEQ ID NO: 1705 - protein, 72 aa, Oryza sativa
VWSLVRRFDQPQLFKPFVSRCEMKGNIEIGSVREVNVKSGLPATRSTERLELLDDNEHILSVRFVGGDHRLK

SEQ ID NO: 1706 - DNA, 201 bp, Oryza sativa
ttggtctctggtgaggcgttttgatcagccacagcttttcaagccatttgtgagccggtgtgagatgaaagggaacattgagattggcagtgtaagggagattaatgttaagtctggcctgcctgccacaagaagcactgagaggctggagctgttagatgacaatgagcacatactcagtgtcaggttcgtgggaggtga

SEQ ID NO: 1707 - RNA, 36 nt, Artificial Sequence
  Description of Artificial Sequence: Synthetic construct
ugagauuggcaguguaagggguuuuagagcuaugcu

SEQ ID NO: 1708 - DNA, 1029 bp, Oryza sativa
atgcatccaccaagtttagtgctagataccttgaagcgtatcaaactatacatagccatgaagctcctgttaccgaattcggaggtgcctcggatctattgggagaaagctcagcatctctgtgggttcctgtccatgaagctcatttccagagccagatgtgtggcaagttctgtcaaacaatcttatagttttctggtttgcaaaagtaaccctttggtagttcagctcgtttactttgtgataatctcatttgctggtttccttgctctgaagaatctcaagccccagggtaagccaggtccaaaggatttggacctattgttcacctctgtgtctacacttactgtctcgagcatggcaacagtagagatggaagacttatctgacaggcaactctgggttctgatccttctgatgctaatgggaggagaggtgttcacatcaatgctagggctctacttcaacaatgccaatgccaacagaaatgagaacagccagagaagtttaccttcaatcagcttggacattgaattcaacagtcctgcaaacaatggggatcacaaaattacggaatgtggccaatcagaagaaactatgtcgcaaaaccaggtacagcaaaacaaaagcataacatataatccttgcgctgtgttggttcgcatagtgacaggttatttcgtagctactgtcatttccagttctgtcatcattattatttacttttggattgattcagatgcaagaaatgtactgaaaagtaaggagatcaatatgtataccttttgcatcttcacagcagtgtcctcgttcgcaaactgtggcttcacgccactaaatagtaacatgcaacccttcagaaagaactgggtccttttgctcctagtgatcccgcagattctagcaggcaacaccttgttttcaccactcttgcggctatgcgtatgggttttggggaaggtcagtggaaaagcagagtatgcttacatccttcagcatcctggggagactggctacaaacatttgcat

SEQ ID NO: 1709 - DNA, 201 bp, Artificial Sequence
  Description of Artificial Sequence: Synthetic construct
atttgttgaagaatgcatccaccaagtttagtgctagataccttgaagcgtatcaaactatacatagccatgaagctcctgttaccgaattcggaggtgcttcggatctattgggagaaagctcagcatctctgtgggttcctgtccatgaagctcatttccagagccagatgtgtggcaagttctgtcaaacaatcttat

SEQ ID NO: 1710 - DNA, 223 bp, Artificial Sequence
  Description of Artificial Sequence: Synthetic construct
gtgttcacatcaatgctagggctctacttcaacaatgccaatgccaacagaaatgagaacagccagagaagtttaccttcaatcagcttggacattgaatccaacagtcctgcaaacaatggagatcacaaaattacggaatgtggccaatcagaagaaactatgtcgcaaaaccaggtacagcaaaacaaaagcataacatataatccttgcgctgtgttgg

SEQ ID NO: 1711 - DNA, 211 bp, Artificial Sequence
  Description of Artificial Sequence: Synthetic construct
ggttatttcgtagctactgtcatttccagttctgtcatcattattatttacttttggattgattcagatgcaagaaatgtactgaaaagtaaggagatcagtatgtatacattttgcatcttcacagcagtgtcctcgttcgcaaactgtggcttcacgccactaaatagtaacatgcaacccttcagaaagaactgggtccttttgctcc

SEQ ID NO: 1712 - RNA, 36 nt, Artificial Sequence
  Description of Artificial Sequence: Synthetic construct
gcuuucucccaauagauccgguuuuagagcuaugcu

SEQ ID NO: 1713 - RNA, 36 nt, Artificial Sequence
  Description of Artificial Sequence: Synthetic construct
caacaguccugcaaacaaugguuuuagagcuaugcu

SEQ ID NO: 1714 - RNA, 36 nt, Artificial Sequence
  Description of Artificial Sequence: Synthetic construct
cacugcugugaagaugcaaaguuuuagagcuaugcu

SEQ ID NO: 1715 - DNA, 350 bp, Oryza sativa
cgcgcttgggctgccccaccgccgagctctgccgcgccgttcgccggtgctgccgagctccgccgcgcctgccggagcacgctgccatggccgccctggagaagacacgagagaattaggtggagggtgggggaagggtgagattttttatattatctatgggtcccattataaattttctaaaccacacttatactgtgggtgcagtgtcatttagagttcccaaaccacctatgttgcagctgtggtataacaatttgctaggacgcattgctactgcccttgtaccctgctataagaagataaccaatgacatctccactcgattttctcggcgcgcgtgtgagggt

SEQ ID NO: 1716 - RNA, 36 nt, Artificial Sequence
  Description of Artificial Sequence: Synthetic construct
cucucgugucuucuccagggguuuuagagcuaugcu

SEQ ID NO: 1717 - RNA, 36 nt, Artificial Sequence
  Description of Artificial Sequence: Synthetic construct
cugcacccacaguauaagugguuuuagagcuaugcu

SEQ ID NO: 1718 - DNA, 300 bp, Oryza sativa
atgtgatagtcatctctgccataaaacttgccataatagttggagacttggtggcattccgggggaacccaatccaaatccgcgacgaattcctctccgccaatacagtattcgtgtgtgccgaggagggaggcagttccacaggccaaggaacttacgtgacctccaaagtcagaggtcggaatctcccttcgttccagccatggcccaccacccttgcggcttggtgaccctactgcgccgccaagtcacccgctcgccaacaaaaacccgcgacgcgagcgcggagacggcagcgcc

SEQ ID NO: 1719 - RNA, 36 nt, Artificial Sequence
  Description of Artificial Sequence: Synthetic construct
cauaauaguuggagacuuggguuuuagagcuaugcu

SEQ ID NO: 1720 - RNA, 36 nt, Artificial Sequence
  Description of Artificial Sequence: Synthetic construct
uacgugaccuccaaagucagguuuuagagcuaugcu

SEQ ID NO: 1721 - RNA, 36 nt, Artificial Sequence
  Description of Artificial Sequence: Synthetic construct
gggucaccaagccgcaagggguuuuagagcuaugcu

SEQ ID NO: 1722 - DNA, 40 bp, Artificial Sequence
  Description of Artificial Sequence: Synthetic oligonucleotide
gccacgtgccgccacgtgccgccacgtgccgccacgtgcc

SEQ ID NO: 1723 - DNA, 44 bp, Artificial Sequence
  Description of Artificial Sequence: Synthetic oligonucleotide
aaaatatttataaaatatttataaaatatttataaaatatttat

SEQ ID NO: 1724 - DNA, 12 bp, Artificial Sequence
  Description of Artificial Sequence: Synthetic oligonucleotide
gtaagcgcttac

SEQ ID NO: 1725 - DNA, 18 bp, Artificial Sequence
  Description of Artificial Sequence: Synthetic oligonucleotide
gcacgcacgcacggacgc

SEQ ID NO: 1726 - DNA, 36 bp, Artificial Sequence; identical to SEQ ID NO: 199
  Description of Artificial Sequence: Synthetic oligonucleotide

SEQ ID NO: 1727 - DNA, 7282 bp, Oryza sativa
tgatcacgttatacttattcttatatttagatcatgaaaaagaagacgtgggagacacgaatataagcagtactgatgatgcttgtgtgcaaaagttagagccagtaattggcatggaatttgatgatgaagatatagcatatgagttctacaatcggtatgctggagatgttggctttagcattagaaagttttggcatgataaatcttcaacaaatgtgattcgcacaaaaaaatttgtgtgctcaagggaggggttcaataagaggaatacttcagatgcatgccaacggaagcgagctgatacaagagttggttgtatggcagagatgaccattaagatcactcctactggaaaatatgctatagctagcttttctaacacgcataaccatgaactcataactcctagcaaggcccatttgttacgttctcagagaagaatgacagaagctcaaaaagctcaaattgacatcttgaatgattcaggtgttagacccaaagaaggccatgaggtgatgagtaggcaagcaggtgggcggcaaagtcttacatttaccagaaaagattataaaaattatctccgatcaaagcgcatgaaatctatccaagaaggggatacgggtgccattcttcagtacctacaggacaagcaaatggaaaacccttcattcttctatgcaatacaagtagatgaagatgagatgatgactaatatattttgggcagatgcaagatcagtattggattttgattatttgggtgatgtcatatgctttgacacaacatacaggacaaataattatggtaggccatttgctctttttgttggtgtaaaccatcacaagcaaacagttgtttttggagcagcgttactgtatgatgaaacaacatcaacatttgaatggttatttgaaactttcaaaagagccatgtcaggcaaagaaccaaggacaatattaactgatcaatgtgcagccatcattaatgctattgggactgtctttcccaactcaactcatcgtctctgcgtttggcatatgtaccaaaatgctgcggtacatttgagtcacattttccaaggttcaaaaacatttaagaatgattttggcaagtgtgtttttgattttgaagaagttgattagttcatatcagcatggaacaagatgatagaggagtacaatttgaatgataaccaatggttacatcatttatttgagatcaaggagaagtgggctttagtttatggtcggcaaacattctgtgcagatatgaaatccacacagagaagtgagagtctcaatgccctgctgaaatatatgcaacatatggattggttcttgaaattttcttttatttatatagagcaaacactcaggcacaaaattgggctttttttacatctcgatctgcagttcaatgtcattaatatttccatttgcaatctaaacaatatatctatgcttatggtgtgtatacattatagtacaagaaaaaattattaagcagttagacattaacctgtgacaggcttggtcgatccagagcaagcccaacctaatccatcaggactgcatgacctctccctgctctaagtctccatggcgaccacggctccttccgccggccactctcccacggtgagcgatgcgacctcctcaggacgccccacggcaagtgcgcaagcctgtagtggcacccggcaagcaccgccgccccaccccggcggcctgcctcgagaccgtcgtcctcttcgatggcccatggtgagcaccacttcccagccaacggcaggtgtgcaggcacatttgcagcagctggcaatggcgtggtaagcattgacctcgctcccgacagcttgccttgagagtatggcgccatgtgcaagatcttttggatgtgctttcactgctttgtgatgcagttcaggagtggttgaggaaagagaaggctggagaggaaaggggatttttttatgggagtgagaaggggattaccaacaggaaagagaaatccagataacagaagttaacgtgatgccttgtgccgtttagtcctcgttaaacctccgttgcatgcgtaattaagtagggccaccctggacaggtgtcgcaatttgatttggcctgtatattattatgtgcagggttccctgcacctgagccggactccttttccagtgacgcgtgcagtttaccaaccacctgctcttctcggccagttcgctgcggacctccaaaacccaagcggagatgatcgcgcaccgtgtcagcgcgtcgcggccatagaagggattcggggagacgtggccgcccgcgcgcccgtcgcgcaccctatcctcgccgcgcgcccgccggccaatcgccacccctgaatccacagccacgccacgcggcccatgcctacgcctcccacccgccacaggatctccctctcacgcgcgcgcgatctcataaaaacctcgccacctcgatcggtgaggtagcacgaggcggcctgagctgaacaccgcatcagcagcagcaagcagctaatcgcgcacgtacgcacaccgcgacccggggcgagatggcgcagtcgatgctggtgtcgggagccaatggcacggtggccgccgcgagcaccagcaggctgcagcccgtgcggccgacgccgttctcgcggctcgtgctgtcgcagccgtcgtcgtcgctggggcgcgcggtgtccgtcaagacggtggcgctgttcggcaggtccaagaccaaggccgcgcccgcaagaaaggttggaatttggatggatgaatgcaagctaaactaagctaagctaagctcgcgtttgttttagtcttatgtttgatggtgctaactattttgtaacgtgtcaacgtgtgtatgtaggctgagccgaagccaaagttcaagaccgaggacggcatcttcggcacgtccggtgggatcggtttcaccaaggagaacgagctgttcgtcgggcgtgtcgccatgctcgggtttgccgtaagtagacctttcttggccttctagttatttggtatgcatcatttcttgccatcttggtacgtacctgtgcgttcgggtttgggttagctagctagcaagagcacaagcttaaacgtcaaaagttttgtggttaacggaagcactttacccgggagcgtcatcctttattctataaagggtcacatgttgcataggtagatttgcttccaactacttttttttaaaaaaaaattatagtttttgtcatatattttactttgaattttctgtgcacataaaaatgctatatttctccttagcaaatattgctacttttattttatttttcagtccgagttttgacagcgacattgtttaatctaggccagttagcaactcacatgtataccacacacataactaatgaattatctggatttagtaatataggtattgtaggttttaaaaaattcgtctttcgagcagatatattgtttaatgagtaaattttagagaactataaatttagtgactaaattatcagcttgttgtaacgttagtgacatattatatttcagtttaggaagaagaggggatttctgaaaaaaaaagaatgaatctccttcctgcagcaataacaaagaaaatcattataaatctacaactacgtgaacaacctaacgttaatcctgctgaaacgccgctcagtcggtgcacctgagtcaaaacctcattccaaggtagggcaaatggccatttcatcttcccctttgccctttttagcttgatgggttttaacctcggtgcaccaaccgagtgcgagtagcattctagtcggaacaaacggaacaattagtttcaggccgattttagttacaaactttttcttcaaacttttaacttttctatcacatcaaaactttcctatacaaataatcttacaacttttccgtcacatcgttccaatttcaactataaacttttaagtttagcgtgaactaaacacacccctagtggagtcgaaccaaagtgatgcacttagttgtcggccgatgtggcatgctgctacgatgcacatcttgacattgacgtgtcatgaagacatgttcctccatcttgccacactatatactacctctatgacacgcgatgtccatgtatcaataatattactaggatgtatatgatgttacagatttgtgatattttttttcttttattactgtaacaaactaaaactggttgtaaatgttgtagcacttagatagtttagtcactaaatttacagtgctttaaaatttactctcgtttaataatttgtatagtgtacatgcatgactagcacaatcgatcgttgagtcataccaacctgatgcaaaagcgctcaaactgtgcaggcgtcgatcctgggtgaggccatcaccgggaagggaatcctggcgcagctgaacctggagacggggatcccgatctacgaggcggagcccctcctcctcttcttcatcctcttcaccctcctcggcgccatcggcgcgctcggcgaccgcggcagcttcgtcgacgaccagccggtgacgggcctcgacaaggccgtcatcgccccgggcaagggcttccgctccgcgctgggcctcagcgagggcggcccgctgttcggcttcaccaaggccaacgagctgttcgtcggccggctcgcgcagctcggcatcgccttctccatcatcggcgagatcatcaccggcaagggcgccctcgcgcagctcaacatcgagaccggcgtccccatcaacgagatcgagccgctcgtcctcttcaacgtcgtcttcttcttcatcgccgccatcaaccccggcaccggcaagttcgtcagcgacgacgacgaagagtagaattacgaggatcgatcgatctaccgaggtttcgccgccattgttgtgcttgcgcatcattgagactttctttcaagtgtatatgtactgtgtacgtgtaggtgtaaagacgtaccttgtttaattagttgttaattaatgcccatggagaaaattaacgtgagatttagctacttgctgcggtaaatctaattggagatgcctctccaattagtcttaaccagagacatccaattagtcttaaccagagacacccatactttaggagttttggttgctattaatccattgagcatctatgcttgaaataaaattatctcttaaattactcatccgatttacaatacgattacaccgttgtgttcgtaataattaaatctttataacaagatctcacatgattatattttgatgaaaaatcacaaattacttttatgatatgtctaaattacttttaaatttcaataagttatttcttagacatataaaagtaaattcagtaaagcctaaaagtaatttacatatagaagtaacttataagaaaagaaagtaactttaatttatgccttttttcattgaacggattttatatatatatatatatatatatatatattatataaaagttacttttagatttgattaaaatactttttatacattcatgatgctctgaggtgattactttctagatagagtcatgtttttatctctacaatagatttacttcaaatgacatgctaaagttacattcgttttgttctaagttacttctataatatatgtaaattacttttagattttactgaatttacttttatatatccaagaagtatcttagtgaaatctaaaagtaatttaaacatatcataaaagtaatttgtgatttttcatcaaaatataatcatgtgagatcttgttgtaaagatttaattgttacgaacacaacggtgtaatcggatcgtagatcgaatgagtagtttaagagaaaattgtatttgaagtataggtggatggtgcctcttatagatagagttgtagttggcttagataaaccagctaccactagtagttgtgttagttgtgtagttacgtcctatttgctgagactgattaaacccgtatgcgtgtggtctgagaccaccggcgttccggtcgccggtgaacctcgccggcgtttcggccgatggcacacatgggcccatatgcaggccgcagcccatttaagcccaagtaaagaggcctcttttctttctccatttttgggcccaatctgttattgcataaacttaacttaagcccatacgtattccaatcagaaaattattagagaagagaaatactggaactgacgcgtcttgcgttgtcttggcttcacaaatcaacaaagatcggcagctgcatcaacatgcctgacacggcacgcatgttatttttgttggttgcgattagatgttaattgatttttctgcgattgaatgtaattacttgaccccgtccgtataatcacacgcacatagaatagaatggttatgcgtatacgaagatgagaaaggaagatacggtccaaagaaattcacaagcaattgaaaacaaacgaatatttttcaaggagcagatctctgttgcttccttttcttctctgttgaaaagggaagggaatgttctctctttatgtcaacgcttatctgacgacaaagtggattggatatcaacactagctcacggcaaggttaacataacatttaatatatgtttcactcttagctgattaggtagtgtttggctaatgggtttgagaaatgatttccaacccaccaaaagacatctttaaatcctaaccatttattttccctttttcatttaatcctaacccttcattcatttctcaatcccaatcccactccccatttcctattatccaaacacacccttagtgctttgaataatattaaccctatctaaaagtgaccctgtagctagcttagctaaaaggaggccctgatgaatcattccattgcgagctgagctgagctgaaaagatgtgtacccgctttgatatatgccatcctgctccatgacacaatcagaaattatatccatgcatattctaatactcctcccgatttcttttagttcaggtccaaactgccaaaagagaaagacagatcaaactaattcttcatttaatcaaataagaggaaaggcttgtggtgcacacatactgcatagcccaactgttgcttcgctgtgggttagcctttgagaggtttcattttgcttcctttccctcaggtttggctaaggacctgcttgctttgtagttaggggatctgattgtctaagtgtatacctaatgcatcacgtatgaattgtgaaatttaattaatcgggtatgtgtacgtacgatcc

SEQ ID NO: 1728 - protein, 268 aa, Oryza sativa
MAQSMLVSGANGTVAAASTSRLQPVRPTPFSRLVLSQPSSSLGRAVSVKTVALFGRSKTKAAPARKAEPKPKFKTEDGIFGTSGGIGFTKENELFVGRVAMLGFAASILGEAITGKGILAQLNLETGIPIYEAEPLLLFFILFTLLGAIGALGDRGSFVDDQPVTGLDKAVIAPGKGFRSALGLSEGGPLFGFTKANELFVGRLAQLGIAFSIIGEIITGKGALAQLNIETGVPINEIEPLVLFNVVFFFIAAINPGTGKFVSDDDEE

SEQ ID NO: 1729 - DNA, 6480 bp, Oryza sativa
taaagaaagggcacagcattgcttgagaaaaaagaactaatgtaggtttcaaaagagtaaaatatttggcaatactacaaaattacatccaaccaacccaagtgataggtaaacactaacactagaatgtcattatggcaatcaaagccctgtactacttgttattaaattgtgcagctaaccagctacaaatgagattcaatggaagtgagtgaagcaagaaagtaacacaattatatgacaggagtcaaacagttgacgtgtacattccatctagggaacaatcctgtacttcccattcatttgggtgaagcaacttaaaaaatatttagcaagctcagaagtgatagagataagaaaataatgaggattacagggttaagcattcaagaacaacctgtgaatcaattttcttcaatgaagactccaattcggcaatatcagcatccaactgaatcgaatctagataacaaagtgttaggtgttgaagggagaactgcgaggagcatgctgttgtcaattaacaggaccttaaataacagagactcaagagaagcaaacctttgagagttgtctctgcaacgctgctaatttcaacagatagtttgcggttctcctcctcagccaagcttacctccttactcaaccattccatgaacgcatctagcagtatgaaaatccaattttacgagtagatttgcacaggatatgtggactaagctcaagctggtatgattatgccactgataaccaacaccacaacaattaaaatggaatcagacagctaaccaaagtcgctctccatcggcgcggcgctcgaggcccatgcgtcgaattccaacccctgcaaaggttcctacaaacacagaacccagaaacacaaaatgatttagcatgcctcgattttctcaaggaaaacaaaattaaaattaaaagcgcacccatttttctctcccctcatagtaataaaattcaaattaaccaaaccctcgacgttcacagccagtccacttaccacgtcctccacggagggaaggcggcgcaccgcgtccgccgccgccgccgccgccgaagcaacctcctcctcccctcgccgcgacagcgcgagccgctccaaccggctgacccaaaaacgaaaacaaaacgaaaaaaaaactgagatgaacgaacacctgatccgcgcgggcgaatcggaggaggacggcggagggtttagccacctaccttcgaatggccgccgcgtcgagcggcgcgtcggcggcgtcctcggctagggtttccgccattagcagcagcagcaatggcaatcccctcccctctcccgcccaagaaaaatttcccccgacttcgaaaaaaatgggtggcgattttgagaaatcccccctccaaaaactccgaactgcgatctagtccgcggccacgtcgggccaaacgggcggcccggcccagcaggcacggctcctgttgcgggccgtgccgtgctggcccacgtgctaaggcctcggaccaagcacggcccagtaaggccacgggccgtgccgtgccggcacgggcccaaatatagcacgtgggccggtgtaggcccattagcacgtttggcccacaaaattgaatatgaggccgaaaaataaagaaaaaatgtgaaaagaagatgaaaaaggaaaatttgtgaaaatattataaaaaatgacgaaaattagtgggaaatagaaaacaacatatggaaaaatcgggggaaaacgagagaaatgagagaaaataaacaaaaatatatgaaaagaaaagggaaaacaggaaaaatttggtgggccaacgggccgtgccgtgccgtgccggcccatggtctcatacgtcggcccaagcacggcacggcccacaagcgggcgtgcctgggccggctacagtggttaccgaggccttggcccggcccatttggccagcactcgccccttgcggcatcgcctcctccccgccacacaaacaagaaggcgagccaagccaagccaagcccctccgcggcgcgcgcgttatccatctccccctcgccgccgccctatcgccgctgctcgagctctcgatcccctcctcctcgctccgccggccgccgcggccgcaacccaggtcagaggaactcaggattccttgtcagttcttgcccgggctcgcatttttccttgctgggtcttgaatctttctttctcttcttgttttgtgtttcttggtcagatgatgccgcggcagtgcgggaatcgcgcgttgctagcggagggatcgagcacggtggtggtcgtccatggccgcaagaccagaggtggtatcagcactgtcacctccagcaggaggaggagccatggcggtgtcaggtaccaccggtgctgccccccgagggctcacctatggaggaagggcgatcatcttcctctccatcatgccaagatctctgctcgttgttccgaggtgattgaccgagtcctcattttcttgtgattgcacactcccaattttgctttcttattgacaaggaaaaaaaggggattgggttttgggtgatttgtttgatagatcaaggcccacacggtgctgcaaggttcagatgctctaagcagcatcagggagtggagcaggtcgcatttggtcaccatgacagggctggtggcgtgtgctgttcttgtagtcccttctgccgatgctgtggatgctctcaagacatgcacttgccttctcaaggagtgcaggtgagtgggattccctttttttgcatttgttccaagcatgattccaaaccgtgtgcattcgccttgtcgaacatcgatactgtaatttttaggaaacattactttgttttgcttaactgaagtccagcaacaccacatgccattgttcaaaacaatgatacaccagcatctactgaatctatgcaattgtcattttgtcaatacagatacagttgatcctgtttaaggcagtacatttttacaatgtttaatcagtcatacaagtgagttctgcggatcttgtgtgttcatatgtttcttataccaatgtaatggaatcaatttcagaatagagctggccaaatgcatagcaaacccatcctgtgcagcgaatgtagcatgcttaaatacatgcaacaatcgccctgacgagactgaatgccaggtggttccatttcccagaaaccaatcagttcagatcatttcctcagaagaataacctgtgctgtatcttgtcatattgtagatcaaatgtggagatctgtttgagaacactgtggtcgatgagttcaacgagtgtgctgtttcgcgcaagaaatgcgtcccacaaaagtccgacgttggcgagttcccagtccctgatccatccgcccttgtcaagaacttcaacatggctgatttcaacggcaagtggtatatttcaagtggcctcaatcccactttcgacacattcgattgccaacttcacgagttccgtgtcgagggagacaaacttatagcgaacttgacatggagaattcgcacccccgactctggcttcttcaccagaacagccatacagcggtttgtgcaggacccagcacaacccgcgatcctctataaccatgacaacgagttcctgcactatcaagatgactggtatgtcccttagatagcaccttctgacgctgtacttcagatttattactaagattttctgaaatgtaggtacattatctcatccaaagtagagaacaaggaagatgactacattttcgtgtactaccgcggcagaaatgatgcgtgggatggatatggaggtgctgttctgtacaccagaagcaaagttgtgcctgaatcaatagtacctgagctagaaagggcggcaaaaagcgtaggtcgtgacttctccacattcatcagaaccgacaacacctgcggtcctgagccacctcttgtggagagaatagagaagaccgtcgagcaaggagagaagaccatcatcagggaagtgcaggagatcgagggcgagatcgagggagaggtgaaggagctggaggaggaggaggtcacattgttcaagaggttgacagatggcctcatggaggtgaaacaggacttgatgaacttctttcaggggctaagcaaggaggagatggagcttttggatcagatgaacatggaagcaactgaggttgagaaggtcttcagccgcgccctgccaataaggaaactaaggtagcttctagttgccactccagcaagtacaaggcaacaagtaatgctcaaaatatattctattcaccaaggcaataccaatagtaacagattattctacagagaacaaagaatttttgaatctgctaatgcatccccattattacaatacatttccagcttagagatatgtaaagtatcagtaactatgtaacttccattaaaaaaaggtatatagtgaactttgtacaactgttccaaatatgatatggattatgtccttttgatgacgatagtttgaatgctgttaattttcttcggtactttatggcaatttaggttatgtcaaatgcaaataatattgaattgtagtttcataatttcatgaacctttcttttactaagaggctctctagaaactttcctattcatcgttaacaatcactgttcagtgggagcttaaaaggagcttgtattttattagtatgaacttctcaagcagcagcctgaaatggttagatggagggtgagagcatatgagatttaactggttgttttcataatcttagcttactctttatgttcttgattcaaacaaggaatcatatggtagctgacaaaatacccctataatcatccaggaagacacagaagcaattctggaaacattttattatcagcaaggaaaatttctcactccatgcttcccagagccaaacggcaccctatatatgtttcgaataatcatagaaactagatgactggaaaattcaattacagatacatactcacaccgacaacaataaacgtggaaaacaatacatgaacagagttcgatgaaaattgaaaattcacaatgtagcaatctgatcaacaagtagctaaggaacctctccagcaatatctgtgatcttatcccccgttgtctcaaagtatacagcaagggcatgtctggagaaaaagagaaaatagatataagtccataatatcacctgagtgtcagtgtaactcataacagagaatgttaactgtgcaagaattaaagaaagtacatctcaatattacagacagtcacacttatttctgaatacggtttgtttactctcgcaagtacttagatatgtcataatttaacattatggtgctaagtttcatcatgtactatgtccaaaacaacaaaccatacaagctgtgccttttaagtaaaatgctgtgatgtagcagtagcattgacatatcagtaagaaggttatgctcaaactccatactgggttgtgtctgtaaatgaaattaactggatctaattgcagtatgtgtaggcgtgtatcttgttcttgagcaaggtttaacatttcattttgttcttcatgttttccccattagaagtgctatgagaaattgtgatataggagcagtaaaatatatgaatagctagtataacaagcacagaaggattatctgccgatggtcatataaccctataatccaagggaatatttctattttgtttgatatgcatcatttttctatggtagtaaagctaccaattccgcaacgaaaattggcaataatatttacagtttctgtaagtggtatccagtaggaattcaaaatcaaactaaggcataaaaatttttgttcatatcagagcctgaaaaataaatgttttttttgtgtatatatacctgtttcactttgttttcctggctgcgattagtgtccggttgcctggtagaagtgtttggcgataatttatcatccctcaccctgttgaagataccagtaaatttttcgcctgatgctgcattaccctcatcccactcaccaaacggtggaacagctacatcatcttcaggctggattggaaaaaaaaaacgcaaaagcaacatcacattactccataggcaaaattctctggattaacaagaaacaaaaagggatttagaatgtactgcatcatagcctcggccaccctgcttgtccctgctcctcctaggagtatgctggccatgtccctccgatgaagccctcctctctggagtctgcattccagatgacctgtgcttcggcttcgatgggttgttcggctgcgctggtgaagcggagccatgaaccatcctgtatgggcttctcggtgcgctaccgatgccaccgcctacctctcgctgctgagaaagcgaatgccgtcgatggggatcagcttcctgccttcttccatgctgtggattcattggactctgcccctgagcatcaggtgtgtatgctggatgcaaaggtgacttggatggag

SEQ ID NO: 1730 - protein, 468 aa, Oryza sativa
MMPRQCGNRALLAEGSSTVVVVHGRKTRGGISTVTSSRRRSHGGVRYHRCCPPRAHLWRKGDHLPLHHAKISARCSEIKAHTVLQGSDALSSIREWSRSHLVTMTGLVACAVLVVPSADAVDALKTCTCLLKECRIELAKCIANPSCAANVACLNTCNNRPDETECQIKCGDLFENTVVDEFNECAVSRKKCVPQKSDVGEFPVPDPSALVKNFNMADFNGKWYISSGLNPTFDTFDCQLHEFRVEGDKLIANLTWRIRTPDSGFFTRTAIQRFVQDPAQPAILYNHDNEFLHYQDDWYIISSKVENKEDDYIFVYYRGRNDAWDGYGGAVLYTRSKVVPESIVPELERAAKSVGRDFSTFIRTDNTCGPEPPLVERIEKTVEQGEKTIIREVQEIEGEIEGEVKELEEEEVTLFKRLTDGLMEVKQDLMNFFQGLSKEEMELLDQMNMEATEVEKVFSRALPIRKLR

SEQ ID NO: 1731 - DNA, 18720 bp, Oryza sativa
tgaaagagcaaggagcaagaggtttcttcagaggatgggtgcccacactgcttggttacagtgctcagggcgcgtgcaagtttggtttctatgaattttttaagaagtactattcggacattgctgggcctgagtatgcagctaagtacaagacattaatttatttggctggatctgcttctgctgaagtaattgcagatattgcactctgccccatggaggctgtgaaggttcgtgtgcagacacaacctggctttgcgagaggtttatctgatggtcttccaaagtttgtcaaggcagaaggctatgctgggtaagttgatagggtcttgtaaatcacattgttcagtaagcgggtctctaacatcagtcttccaactcaatgtttactgtgcagattgtataaagggattgttccactctgggggcgacaaattccttgttagtacctatctcctttttaagaatttgcacatgtagcgacgattgtctaatttttaaagtcagttagtgatcattttacataaaatgtataaatttttagtgcaaaacctgattcatgcagcttatcctgttattgaagggatgggaactcctgagatacttgttttttatgtagtgtacaatgggcatgcatgaatgattaagtggttcattcatgactttgccatgaaagagtacaattgagttaaaaacataatttcaatgtttccattacagcaatgcacatagttcttcttgaaatcacccaatggtttcaagtttttatgtgtgcatatattgatttttccacactgcttgagctatctctattacactggacctagactccaatgaagtggtatacattgattactggtattatttcaattattttgtaccagcagttattatgatatgatgtgttgtagatgatgtcttatgatctgtcatctttgttgtaatgtcatttttttttcataatggtgaaaactgttggccttgaacaattatttaacatgattgcaagcaccagtgctctatgaattctttgtacatatttaatggcaactccagtttagtcttgtaggatttttttttgggtgcacatagttcttcttgcaatcataccatgggttacaagattttatgtgtgcatatatatactatccacactgcttgagttatctcttctatgttggagataaactccaatgaagtggtgtacatttatttaaaataagcaaattgaatttcttgtggggaattttctgcctttgtatatttagtacccattttgattttaagttgtgggcaattgatcttgagacatacaatgtttcatggcaattccagtttagtcttgtaggatttctttttttggtgcacattagttcttgcaatcgtaccatggtttacaagattttatgtgtgcatatataaactatccacactgcttgagttatctcttctgttttggaggtaaactccaatgaagtggtgtacatttatttaaaatagacgaattgaatttattgtggggaatttttctgcctttgtatgtttaggacccattttgatcttaagttgtggcaattgatcttcagatgtccatgcaatgttgaagtacatttcgagcagcatccaagatacttttgagtgatgctatcatgctgtctatatctgcatgcttggacataaaggccttgcattttttgtgcacattgttcttctggagatcacactatgattttcaagattttatgtgtgcatatataaattttccacactgcttgagttctctctattactatggagctagactccaatgacgtggtgtacattaaacaagtgcctaactcatgtgaatcttatatcgcttgcagcctgcagcaaacacctagtttaatgattttctcttttagtttggatatctgtctgctcaacttatctccttttttgtagcaatgtccaatttggtgatttacatgaggatagttcatcagctgtatgttcagcaattaaataagtcaatacatttgatgttgggattttacattctaggttctctgttgtgattgtaaattagtttttgctatgatactgagcactgatattcagtatgcagcaatcagattgttatcccgttgagccttgagtgcttttcatgaaatttaattaatttgaccattttatgatacacagatactatgatgaagtttgcgtcttttgaaaccgttgttgagatgatatacaaatatgcaatccctgcccccaagagtgagtgcagcaaaccactgcagctcggtgtgagctttgcaggtggttacattgcaggggtgttctgtgcaatagtttcacaccctgcggacaatcttgtgtctttcctcaacaatgccaagggcgcaacagttggcgatgtaagttttgtaatcaccataccatcttctgtaacgtgtttgttggatttattatttcttgttgcatttacaggctgtgaataagcttggtatgtggggtctatttacgcgtggactccctttgcgtatcgtgatgatcggtactctcactggagcgcagtggggactctatgacgctttcaaagtgatggttggactgtaagtgttcctctttgttgattctggcctctgccaacattgatattgaccaacttcaggaagatttatttggtttgttctcttctaggccaactactggtggagttgctccaacaccagccaagtgatggttggactgtaagtgttcctctgttgattctggcctctgccaacattgatattgaccaacttcaggaagatttatttggtttgttctcatccaggccaactactggtggagttgctccaacaccagccattggtgaagagcagctgaaggcctgatgcttgattctatacttccgaacttctaacaattccgtgccaacttggatgatggcgaaataggttcttagtttagaaacaaaaaggattttgttgacgaatgcttatagttcattaattcaatcgctgctaaaaaaaactgagataagcatgctcagggcttacaaattataagggtattgcggtacagagtttaggatagtagtatagatggccattcgatgaatgatgcttgcgtgaatgaccgtggcatccttcaatttttgtaggtctattttttttattgcagtagaaatgttgattacgccttgggccttggctctatcttttgctggccggttgttatcgttgtaactctccgcggtattcgttcttttcttcagatgtcaataatgcaatctgtgtagtgttccattcaatataccactgtatcatatctctctattgtgctagtattaatgaagctgtcgataagtatttgacaaccgaaacaaataaactttggacatatgaatatgagaatttatcctccctcctcacatacattatcgttcattcctcaactttcttaactcatctcatttattttcacgctcacgtttttcaactgctggttttttagaagttgctttataaattcatattaatccatttttatgtgcagcgagttttcaagctcacctctgaacacaaccttagtagatgttatcggctactgagaattgactgctgtgaatgggttcgcttgtagacacgtcacctcgcactggtaggtactggctggttttggtgagtcggttaatcgtgcattcctttggcgtcttacagttttgtcaaaagataaaaattaagaaagtcacgtctcataaaaagtatctcggagtgtcactctccaacaggcacacactgcttcaggagaaccggatgaagccatacgccaactgagaaaagatctccaaactcacctatgaaagagcaatttgccacgtctccacgcgtgcttctctagttcgttttctgatcttctgtggatattattactgcatgacgttttgcttgctatggaatgcaccttttcgagccaagccaacccaacccatgataaatacaaagatataattaggaaataagtccgaacttatttgtccacgcctatcaaaatctataaagttgtgtaaacaacaagaaactatgtaaaatgtaattgtttagttaatgacataaggataaaactataatgttgtggtatataaaaccgaataaaaaattactgaatacaaaacgcttttgataacgtgggaaaacacatttacaaaacacctaattctaccaaacctttacaaaccgcttgggctatactcctcccatagaatttaatggtgtgaatggacatgcaagttaatatgtcatccgcacctccgtgctagtaggcatatggttttcgagcggtctacttcagttaatcatgcatccctaagttagtaccttgcaaattttatcaaaagattagaaatgaagttagtacgtataaaatatctagtacgagtttatacgagataatagatagaaaacaattaaccttataggttgaaataggattggaaacttatcttcataaatagttgtaattttttcttacgctttttttagaggtatagatatttgtgctaattaagaggtaatccatcctttccaaattgatcatcatataagtttatgcaccaagaccaagaacaatttaaatcacatcaatcaagacaccatgcacatattctcccacaatgcatgcatcgattaaaaccctataccaattacaccctagcatgcacacattcttccatattgtattaattgtattccaatgaaatccatatccatgcagttatatgatgattagaaattttggattttattacatgatgatcaatttgggaaggagggagtatatacctttagggtggagatatattcttcggactaacactatgagtatatatacctctctatacctcataacaacttaaagttttgtagtgctaatcataaacttatatttttcaatcagttaaactagtttaatttttttacctcatatattatgagaatgtatatacttttgcaatggaagaaaacctcaaaaaacaattccctttagaattaacggtgagaaggtcccagttcaaacgttggacatgtaatctcaatatatatgagtatttagttctcaattctgaataaaatttacatttgaaacacgaccaaagagccaataattagcttgtctaggcagttggccaagcttaacaccgccgcaataaaattaccatgatactaatttttaagacgaaaaccacgtaccataatgtaatgttataacaaagaaaaatctactccattgtaagtgatacccccatgaactgtgttccacaatattttgatctccaccataagtctttcaattctctaattatttgatatatgcctaataaaccatgaaaaaaataaactaagcaaccaagagtaatttattagcacaaacattaacagtgttcatagcggattaaaagccaatgctaaaaatattacaaactttaaaataaactaaaaattatgtttcaaaatttaaattttggatccagttgacgacgagagactagcagtttactgctttgaatactctggtaaaaaccggtgcaccgctcttcttctacaaatggacaactaggttttcggctaccgttctacacggccacacatggttagccacccagcggtccgcgcacagaagatggtgagaacctggcaagataaaatcctgagccagcgtcatccgaccttccaaatggaatcaggcgattggctgcggttcctcctccctccaccaccacaccaccaccggtcgcctactcgccttcgccttccctcctctcctcccttccacgaccgcagcccaaaacttctagaagcaaccgccgcgagcttaactgctagtactactaacacctcacctacctccctcccccgccattgctccgtctccgctacacgcgaagagcttcacctgactctcgcttgacgtgctagttagtagtagctctcgatcgaggcgcggtcgtccgtcgagggcgcgtggccatggcgctcctctccgcgaccgcccccgccaagacgcgcttctcgctcttctcccacgaggaggcgcagcacccgcacccgcacgcgctctcggcgtgctgcggcggcggcgccagcggcaagaggcagcgggcgcgggccagggtggcggcggcaatgcggccggcggacgcggccgcctccgtcgcgcaggcggcgtcgccgggcggcggcggcgagggcacgcggaggccgcgggtgctcgtggccggcggcggcatcggggggctggtgctggcgctggcggcgaggcggaaggggtacgaggtgacggtgttcgagcgcgacatgagcgcggtgcgcggcgaggggcagtaccgcgggccgatacagatccagagcaacgcgctcgcggcgctggaggccatcgacatgtccgtcgccgaggaggtcatgcgcgaaggctgcgtcaccggcgaccgcatcaacggcctcgtcgacggcatctccggctcctggtacgccactcccctccccttcccttctcttttcccttttcggatgaaaccatccggttgcatcagactccagtgagcaatgtcttcgtaagttcgtactcgtacagtcgtactgcaccacagtgtaactaaaaacattcatttcagtcacgccatcgtgtgtttaattaacgattctgaccataattaagggcttaataataatcacctcgcggctgcaaccctagcagtcagactatgagtcctgaagggtgtgtttagttctttgggtgtaaaatttttaaagtatacagatacattcgaagtattaaacgtagactaataacaaaacaaattacagattatatctataaactgtgagacgaatttattaagcctaattaatccgtcattagcaaatgtttactgtatcatcacatagtcaaatcatgacgtaattaggctaaaaaattcatctcgcaatttacatgtaaactgtgcaattgattttttccccacatttaatgtcttatacatatgtccaaacatttgatgtgatgttttggccaaaattttttggatctaaacaaggccatgtagttataattttgatccacgttttaataccaaaattttactctgaatcatcctctaactaatattttcactttagataagattatcgttgttgtactttggatcatctaaatcatttctctggctgcatctaccatctaatcttgcaaagaatagcctatatgtatgtcaggaatattatcggtttacatgtaccgatgtagttaaaattatttatacgctcgagagaagtttttgaggtggttcaaactaaaataaagatagctaaagtgaaaaaatcgtttaaaagacactacgttcaaagtgatttttttaatacgggtgaccgtaaacgtattttactcttttgtttactcgagtctccagcatgttacttgtgcagttgctaggcgcgccgctgatctcacgaacacacgtggtgcgacgccgcttaggccaggcgacccacgttggagccgccccaccagccacggcaaattgaaaagaaaaacacctggttagagcaagtttaacagtatagcccactactatctccaaatcatctatagccaatgtaatagctaattcatataatagggcttactatactatcaatagctggtcccatttgtcataaatgtcttggagcctgtgctgcagctctgtagtcaactactcttctctctcttcttttatctctttaaaatatgtttatagctggtttagagcaggtacaatagcaggctataagctaaactataaatatattttaaagagataaaggaggagagagaagagtagcgggctatagatatgtagccagctgcagtacgaactctaagatgtaatgtgggtatgataggtaggaccgggtattaatagtatagtaagcaattatatgaattgactattagattagatatagatgaattgaagctagtagtgggctatactagctctcatcagtcagctggtcggcgtcggcgtcgtcgtcgctgctttccccttctcctggccccgccggcgagcaacccgcgcccgccacgtacgcgcgtcccacttccccccaccccacacgctgctccactacgcgccgaaagggtgaaaccacccatccggcccttccattccgcggcgggtgcctccaattcgtcgagcacgagcgagtgagcgacatggcttctaacacaccaattcgtcgaacacttccgatcgtcttctctgtctccgtgtgagtattgacctcaggcgccgcgacgtctgcaagagtagtcagattcaggagatgctcgttgggtagagcggatcggagagtcactgtcacagtagcgcttctgctcttgcttctcggatcccaccacccaagaagagctttgctttgctcccgttccactgccagtgccagccatggcgccactcccaagctccagctcaacgcgggccacctctctcgtggcgatcccgggcgcctcctgcccccatggccaggcgcaacgcctgctcgccttccgtcccccacgacgcgggtcacagtggcgcgggctttgcgtgtcccgggggcgccacggggcgaccgtcgccatggcaatgccggcggcgcaggcggcggggcgcagggcgcgcgtcctggtggccggcggcggcatcggcggcctggtcttcgcgctcgcggccaagcggaaggggttcgaggtggtggtgctggagagggacatgagcgccgtgcgcggggaagggaagtaccggggcccgatccagctgcagagcaacgcgctcgcggtgctcgaggccgtggacgccggcgccgccgaccaggtcatggacgccggctgcatcaccggcaaccgcgtcaacggcatcgtcgacggcgtctccggctcctggtaaggagtcaagtcgtgccagcgttagaagcgaattgcaacacccaccaaggattggttgcgtctatcaagcctaaaattatggggtttttttttctcctttctagaagtactaagtgtaagaataatttgctggtttacactattggccgtcctgtttgtacaagttttgcttacctattgctacaacctacatgagaatcattaatcacagacctatagtttcaattacagtacaatactgtacaaggaaatgcaatttgttgcttaatcattagtgctaacttgacatataaggcaattattctttgtgcttactctgctacatttgtttgcatttgcaattctgaatgttgttgtctgcttgttggttagctttaagatgggaactcaactgctgaaggcatccatttgactgtgtcaaattggtattcaggtacatcaagtttgatacatttactcctgcagctgagcgaggtctcccagttacaagggttattagccgaatgacgctgcagcagattcttgctcgtgcggttggtgatgatgctatactgaacgatagccatgttgttgatttcatagatgatggcaacaaggtgaatgatcagtttgtcattgtggtcaattggccatatcctcagtataaaatgtgctcaaaatgttatggaaaattcttatgttatggcttttggacaagtacaggtaactgcaattttggaggatggccggaaatttgaaggtgaccttttggttggtgctgatggaatatggtcaaaggtaatgtaatcactcaaatcttttggtaacaattgacaaacataatcaacagagacgtgatttgagaatttaattattggacaggtgaggaaggtgcttttcgggcaatcagaagcaacttattcagaatatacttgctacactggcattgcagactttgtgcctcctgacattgacacagttgggtatgtagtgcggattcagatgactgctgtatttttttcctctgttaggaaatactaatatgttcctcattttcttctgttgaaggtaccgtgtatttcttggtcacaaacaatatttcgtctcctcagatgtcggtgctggaaaaatgcagtggtatgcatttcataaggaacctgctggtggcactgatcctgaaaatggtgagttcctagagtgaaacttttgagctcacaagcatatgcgggccctgtctgtgttcttattgtccactaatgctttttattggcaggtaaaaataaaagattgctcgagatatttaatggttggtgcgataacgtcgttgatctgataaatgcaactgatgaggaagcaattcttcgccgggatatatatgaccgaccacctacttttaactggggaaaaggtcgtgtcactttgctaggtgactctgtacatgctatgcagccaaatctgggtcaaggtggctgcatggctattgaggtacacaattaacttttcatgtctctgatgacactaccagcatggtggatgcatttcttgccctggtattgaaactcagcatatatacttatgttactgtggcaattttttcccacttgatttcacaggatggttaccagctggctgtagaacttgagaagtcctggcaggagagtgcgaagtctggaactcctatggatatagtttcctccttgaggaggtaactgttttttatgttttatcatactagttttacctagatagaatgtcttctggcatcgactagactttatgtcaatacggatcaaaattattcttcaaggccatcttattgtgtatactcttaattctttaggtgtgatcctcagtcatttgattgatgatcaagacattattgtgcttgtgtggctgcagatatgagaaggagagaatactacgtgtttctgttatacatgggttggcaagaatggcagcaatcatggctaccacttatagaccatacttgggtgtgggtctgggaccattgtcggtatgtcaagaacttgttctgctttgtacttctaatatctaaatgtacttatgtggtttatgcccgtcagccagttttaacctgcttattatgtctgttgctgattattttattttatttctgaaacaagtttctgatttagattatcatcataagaaaatcattgaagaatcgcagactaaaattatttggtcttaatatggatatctgtccaatgcagtttttaacgaagttgaggataccacatcctggaagagttggtgggagattcttcatcaagtatggaatgcctttgatgttgagctgggttctaggaggaaacaggtgattattgagctataacttcgattttattttgagctcacatgtagatacataatctgaaaatactcactagattggcatggttgttattactcaccatatgttaatgtcaccaatgaacagcacgaagttagaaggaagaccgttaagctgtaggctttctgacaaggtatatctctattctgtatgatttatcaatgtggggcagtgcaatattttccttttctgacttttacaatcatgctgaaggcaaacgaccagcttcgtcgatggtttgaggatgacgatgcattggaacaagccatgggtggagagtacggtcttacttgtcttcagaattttgatttcattttatgtcaaatatgctctgtataatccttcttaattccagtgcctttgagaaaaggtactcattagaacaatgctacttgcaggtggtacctcctccccacaagttctggagactcgcaacccattcgattaatcagggatgaaaaaaagtcactctccattgggtaggtctaaataataaatctgttattttttggtaacactttcttcaaggattgtagaataaaacaaaattgttcttttgcagaagccggtcagatcccagcaattcgactgcttccctggcattgcccttgccacaggttagataagcaaaatgatggcatcaaatatttgttggaacttctttcgaactataaatgcattgcaacggttcttaggtggagacattcaacagctgaattttgttttacttattactacaacctaattttctcttgcctaaaaaaatcttcagttttatttctgtcaataaaaaactaatgcttctccaatttgttcaacttcattgcagatatcagaaaaccatgctactatcacatgcaagaataaggccttttatgtgactgataatggaagtgaacatggtacatggattaccgagtaagttctgaaaaccgcatgattctttgctcttgccctgaattcgaaatggatgcatcttactaattcagtcccatgtggactctccagcaacgaaggtagacgctatcgcgtacctccgaacttccctgtccgtttccatccctcggatgccattgagtttggttcagataaaaaggtacccaaaccttactgacaccgtattgtaccattgtctcctctcattttgttcagaagaaccatttgcgttgagttgctgcaaaaattctgagttctgatcaatttctacgaacttgcaggccgtgttccgtgtgaaggtgctgagcacgctcccatatgaatctgcaagaggagggccgcaaatcctgcaggcagcatgaacgagagacttcagtcagccatggctgctgtcatcactcatcagctactgtacagcatccagtaaaacacagtgaattttgcactaaaatgcaggttccacttccagacaggattttgaatagctttctctgacggattgaaattgcagttctccatacagaaactgaggtgtacaatataaaaaaaaagaaactgaggtgtacaatagccaatagggacaggcaattttagctgttgcctgctgtatatacattgttgtgccattacagcaacaaggtggaatgtaattacggcatgaacacaatttaccaaatggaaaaaaatgtagctaaaaaccgctttgtttggtaactagttgtacttttccgaactttcttccaagcggaggagccttaccttgccacgatgcgatctgatttctgaactagaacgtcagccacaatgcgccacatgcaccaccgcagagcgccgccgccaccgccgccgccgccgcagtgttcgccgccatcgccgtcgggaaggcgaggtcatgggagtgtgagatttgggccgctagttcggcgtaagagcccttcccagccgttggatcaccattgctcggtccagatttacgccaggttaggcttgtagaatctgcgaggcgtctcctgcctggcgctagccgctaggctccccactccccgcgagcttcagccatgtccgcccgagccgccgccggcggcggtgacggcgatggcgggggccgccgcaagacccttgccaaggtgtccctctcctcgctctccgccgccgcggcggaggcggccacgttccccatcgacgccgtcaagacgcgcctcgagctccaccgcggtacagggggcagcggcgggggaggcgggggcgtcatgcgcgtcgctggcgagctcgtacgcgacgggggaatctaccggggcctctcccccgccgtactccggcacctcttctacaccccgctccgcatcgtggggtacgagcacctccggtccaccttcgccagcggtggacgagacgcgggcctcctcgagaaggcgcttgctgggggtgtctccggcgttgtcgcacaggtaacacgtctccttaaagatcagactcgtctcgctcgtttgttagcacactagatcgaactgtgctctattctgaatttctgatgggtagtactactaggcattgtactgtctgtacacattactccccaagttactcagggaagatcattttgatgtttgattattgaagttaggatatgttttttctcggtgtaaaagtaagaactgctttggtagtattacatttagaagatggaattgaactggacttggggacttgacaggattggaactgttttttgctggacttgttgaagactgtaacatgctagcatttcttagttccaacctattggttccaaacaatgatgcacattatcattaagtaaaaaattcaacaaaatagacatatacatcttaaggcaggggaagggatcttctaatttgtgtcattaccgttaccaaaattatagtatcacaatgcagatgataaagcagcagacatcagtctggatgtgtttttgtatgacaggctcatttgtctccaagtctccaccacctccttatgatccaacctacagtacactcgagagccacaatgagaccatgccatccctgctgacaatgcattgacacattgatggactgtaggacttgtgtagcgcaagatgtgtgcgataggacacctctacctcaaggtcacttgcgtgactagtataggaaagaggcgatacctgggtactcaatgatgctgctcctcgagggttgtgaataaggttgattagaaaaggatgacctgactagcaccctcatttaggttttgaatagtttgtcattcctagagtaaagtagcaagcaattgagataatcaaaacattttagtttgttagagagagattttgtaatcaacatgctgctggtattaaccatctgttagaagtagaattgatatagcttaatagctgctattgtttcgttgatcatttattgacattatagttactctgcagtgcaggtggtggcaagccctgctgatctcatcaaggtaaggatgcaagcagacagcagactgttgagccaaggtatccaaccacggtatacaggaatctttgatgcctttacaaaaattgtacgggccgaaggatttcgaggactttggaagggtgttgttcctaatgcccaacgagcctttcttgtcaatatgggtgaattgacatgctatgatcaggcaaagcatttcatcatccggaagcaaatctgtggcgataacctgtatgctcacacacttgcctctgtcgcatctggactgtctgcgacaaccttaagctgcccagcagatgtaatcaaaactaggatgatgaaccagggcaaggatgcaaaagttctatacaggaattcttatgattgtttggtcaagactgtcaaacatgaggggttgacagcattgtggaagggattcttacctacatgggccaggcttggtccatggcagtttgtgttctgggtttcctatgaaaaattgcgccaagcatcaggtatttcgtcattctgatggtgctggcttagttttatcttacatgattacagggagcatccagaataagattttgttaattgtttagctcggcttgtggcattatcatataccatgcttgtcctcatttactcttgaccatgtctgagtattgtacccatcgctgaggatgcagtagttacaaatcaccaccatgtaactttataattataattgacaactagctgggtggcccgcgcaattgcgcggctagcacccatacagaattatctatttttaatatgattttacttaatttttattaaatagctatctcattttcttaaaactttgaaaggccaaaccttatcatcctgtgtttctacttttataggttttttagaagtcacacaggctatttgcttctgtctaccccttatttctatcaccctcttctttatttgtttactcgatctattgccgtttctgttcattctccttgtaacctttaaaaattgaatattatagtttttagtgtttattatctcgttggtttcatttttataatttttagaagtcccatcaaatgctgccactatgcttctctacggcctattctctgtctcctctctttattgtcattgggattttaaaaatcaaacataattatcatttggattcatttcgtttactttaaatcctaccaaaccgttagtggcttagccactgtactattataagtctcgtccgctgcctcccctctttcctgtcattgagattttaaaatcaaacatgattatcattgtttttttttactttttagaagtcccgaacctttaaaaattggacctcgtagtttttagagtttattgtctcgttgggttttatttttgtaattttcagaaggctcgtcaaacactgtcactatactcctctacagctcgtccattatctctttttgttatcattgagattttaaaaatcaaacataattatcgtttaggttttgtttttttactttctagaagtcccgtcaaaccatcaatggatttggcattatactcctttatggctcgcccgttgcctcttttctttatcgtcattgagattttaaaatcgaatatgcttattactgggatttatttttattttatagaagtcccgccaaccgtcatgaccgtgttgcctaacggcatgtccgttgtcccttcttttaatcgtcattgagatttttttaaatgttttgttaatagtttttcgatgtcccatcaaccatcaccactgtacttctttatacatcggttgtttctcccatctttattgtcatttgtcatctgtgttctagatgatttttttgtttgaaaattccgtatttttcattccaatattttttatttataagtcatattcatacttgaacccttataattattttatattttcgggatcattttatttgacattccaaattttaattaatatcatcatgtgttctagatggtctctttgttcgatagtctttattatttataaattgtattcctagatgaacccttattttttttctaatttcagattttattttattttttattttgaattttaaataatctcgtattgtgttcttatatctactattattttaatatttctaatttcaattgtttaaaaactatagccgttgcttaagtcatcaaaattttggcttgcctatagcttccgcgtggaaggagcaacgtagcctatagcttaatatgcttgctagctgatagctaggattggtttgtctttcaatttttttaaaagtggtgtgtgcacgcggattcctggaacattgtcagtttccaatgtattgtatgactcggttttccttattttcattttgacttattgcccgattaacttttttgttttttcctttcagtttttaactaattctaatcctaaatctagttctatttttctttttccttatttttttggattaatcttattttcgttttgactgattgtccggttcactttttttttcctttcttcagtttttaactaatcctaatcctaatctagttctatttttctatttttatttttttggattaatgtgagaatttctagcccgtgaaagcaaacgtggaggctcctttttctattactttaaagatataatagattctcgctgtcattggtcattgatcaaaataattcaattgcttcattattacatttccataaagtttccatactctttttcatacgatagttgccatgttttccttttcacttggtaacattgttctctcaattactatagttttgtcttgctaatgtgcaaagtttcttatcttgagaaatatcatatcatacaaacttgattacaattcagtaaatgttttcttaatgctttaacaacaaacaagtgaagaacagtgcagatggacaggcggagggacaatggaatgcaactcagtccaccaattgaacaccatccttgaggtcctcgcagtgccggacgtgccggaccgtcttgccgttgtcacctttggtcctcgcctggcagtcgtagtgcggcggtgtgtggaagcacggctcgacggtggcggctagccggcacggcgggttgggcgccttcttgcggacggggaccatgagcacccacggcctcagcccggccagcccgtggctgacgtacccgaacgtcgaggcggccgacgtgagcgccacgtcggagaagctgagcagcatcatctcggcgagcgccttctggttgtgcatccgctcctccgaccgctgcccgcccaggtgcgtcggctggaatacgctcaccgcgtccccgcccgccgcgccgtgctcgtagtacatgtccctgatcctctcgtagtactcgccgtgcagcgacaccacgagcaccgccttgcgcctcgccggccgctgctgctgctgccgcccggagccagggatggcggtggcgttgtcggagccggagctggactcgcgcacgcggggcaggatgttctcgccttgcgcgcacgagacgatctggccgtagagctcgtcggtggagatgggcgcccaggagaaggtgcgcacctggacgccgacgcgctcctccgccttggccaggtacgagccgtggtaccgcatcaccatcccccacaccgtgttgctcgggtggaacaggtagcggccgaggtggtggaacacggcgtcgcggcgcgggaacatccgcgacagctcgcgctcgtaccgcgggatcaggaagaggcccgggacgaagtagttgtcggagaggagcaccacccagccgacgcgccgcagcgcgtcctgcccgtcgtcgcagaagaagagccggtcgctggcgcccgggcgcgtgtagtcgtgccgcaggtgcacgtacatccacggcggcggcgggtcacggccgccctcgcctcggcccagcgcgttgccgaggctctcgcgggtgcgtatgccgaagcgctccatgccgcggatggggaagtccttctccgggaggacccacgtcgcgccgg

SEQ ID NO: 1732 - protein, 659 aa, Oryza sativa; identical to SEQ ID NO: 1621
